US007309604B2

United States Patent

(12) United States Patent
Alitalo et al.

(10) Patent No.: US 7,309,604 B2
(45) Date of Patent: Dec. 18, 2007

(54) MATERIALS AND METHODS INVOLVING HYBRID VASCULAR ENDOTHELIAL GROWTH FACTOR DNAS AND PROTEINS

(75) Inventors: Kari Alitalo, Helsinki (FI); Markku M. Jeltsch, Helsinki (FI)

(73) Assignees: Licentia, Ltd., Helsinki (FI); Ludwig Institute For Cancer Research, New York, NY (US)

(*) Notice: Subject to any disclaimer, the term of this patent is extended or adjusted under 35 U.S.C. 154(b) by 187 days.

(21) Appl. No.: 11/064,774

(22) Filed: Feb. 24, 2005

(65) Prior Publication Data

US 2005/0267024 A1 Dec. 1, 2005

Related U.S. Application Data

(62) Division of application No. 09/795,006, filed on Feb. 26, 2001, now Pat. No. 6,965,010.

(60) Provisional application No. 60/205,331, filed on May 18, 2000, provisional application No. 60/185,205, filed on Feb. 25, 2000.

(51) Int. Cl.

| | |
|---|---|
| ***C12N 15/00*** | (2006.01) |
| ***C12N 5/00*** | (2006.01) |
| ***C07H 21/04*** | (2006.01) |
| ***G01N 33/53*** | (2006.01) |
| ***C12P 21/04*** | (2006.01) |
| ***C12P 21/06*** | (2006.01) |
| ***C12Q 1/68*** | (2006.01) |

(52) U.S. Cl. .......................... 435/325; 435/6; 435/7.1; 435/69.1; 435/69.7; 435/69.8; 435/320.1; 536/23.4; 536/23.5

(58) Field of Classification Search .................... None
See application file for complete search history.

(56) References Cited

U.S. PATENT DOCUMENTS

| | | | | |
|---|---|---|---|---|
| 5,498,600 | A * | 3/1996 | Murray et al. | 514/12 |
| 5,607,918 | A | 3/1997 | Eriksson et al. | 514/12 |
| 5,776,755 | A | 7/1998 | Alitalo et al. | 435/194 |
| 5,785,965 | A | 7/1998 | Pratt et al. | 424/93.21 |
| 5,792,453 | A | 8/1998 | Hammond et al. | 424/93.21 |
| 5,840,693 | A | 11/1998 | Eriksson et al. | 514/12 |
| 5,851,521 | A | 12/1998 | Branellec et al. | 424/93.2 |
| 5,928,939 | A | 7/1999 | Eriksson et al. | 435/325 |
| 5,932,540 | A | 8/1999 | Hu et al. | 514/2 |
| 5,935,820 | A | 8/1999 | Hu et al. | 435/69.4 |
| 5,955,291 | A | 9/1999 | Alitalo et al. | 435/7.23 |
| 6,040,157 | A | 3/2000 | Hu et al. | 435/69.4 |
| 6,107,046 | A | 8/2000 | Alitalo et al. | 435/7.1 |
| 6,130,071 | A | 10/2000 | Alitalo et al. | 435/69.4 |
| 6,221,839 | B1 | 4/2001 | Alitalo et al. | 514/12 |
| 6,235,713 | B1 | 5/2001 | Achen et al. | 514/12 |
| 6,245,530 | B1 | 6/2001 | Alitalo et al. | 435/69.4 |
| 6,331,301 | B1 | 12/2001 | Eriksson et al. | 424/145.1 |
| 6,361,946 | B1 | 3/2002 | Alitalo et al. | 435/6 |
| 6,383,484 | B1 | 5/2002 | Achen et al. | 424/133.1 |
| 6,403,088 | B1 | 6/2002 | Alitalo et al. | 424/139.1 |
| 6,451,764 | B1 | 9/2002 | Lee et al. | 514/12 |
| 6,576,608 | B1 | 6/2003 | Lee et al. | 514/2 |
| 6,608,182 | B1 | 8/2003 | Rosen et al. | 530/399 |
| 6,645,933 | B1 | 11/2003 | Alitalo et al. | 514/2 |
| 6,689,580 | B1 | 2/2004 | Achen et al. | 435/69.1 |
| 6,730,658 | B1 | 5/2004 | Alitalo et al. | 514/12 |
| 2002/0120123 | A1 | 8/2002 | Rosen et al. | |
| 2002/0123481 | A1 | 9/2002 | Oliviero | |
| 2002/0127222 | A1 | 9/2002 | Achen et al. | |
| 2002/0182683 | A1 | 12/2002 | Hu et al. | |
| 2003/0008357 | A1 | 1/2003 | Hu et al. | |
| 2003/0028007 | A1 | 2/2003 | Hu et al. | |
| 2003/0125537 | A1 | 7/2003 | Achen et al. | |
| 2003/0166523 | A1 | 9/2003 | Achen et al. | |
| 2003/0166547 | A1 | 9/2003 | Oliviero | |
| 2003/0166873 | A1 | 9/2003 | Lee et al. | |
| 2003/0211101 | A1 | 11/2003 | Wise et al. | |
| 2003/0211988 | A1 | 11/2003 | Epstein | |

FOREIGN PATENT DOCUMENTS

| | | |
|---|---|---|
| EP | 0935001 | 8/1999 |
| WO | WO 91/02058 | 2/1991 |
| WO | WO 96/26736 | 9/1996 |
| WO | WO 97/09427 | 3/1997 |
| WO | WO 97/12972 | 4/1997 |
| WO | WO 97/44453 | 11/1997 |
| WO | WO 98/02543 | 1/1998 |
| WO | WO 98/07832 | 2/1998 |
| WO | WO 98/20027 | 5/1998 |
| WO | WO 98/33917 | 8/1998 |
| WO | WO 99/30157 | 6/1999 |
| WO | WO 00/21560 | 4/2000 |
| WO | WO 00/24412 | 5/2000 |
| WO | WO 00/25805 | 5/2000 |
| WO | WO 00/45835 | 8/2000 |

OTHER PUBLICATIONS

Achen et al., *Proc. Nat'l. Acad. Sci. USA*, 95:548-553 (1998).

(Continued)

*Primary Examiner*—Marianne P. Allen
(74) *Attorney, Agent, or Firm*—Marshall, Gerstein & Borun LLP

(57) ABSTRACT

The present invention provides polypeptides that bind cellular receptors for vascular endothelial growth factor polypeptides; polynucleotides encoding such polypeptides; compositions comprising the polypeptides and polynucleotides; and methods and uses involving the foregoing. Some polypeptides of the invention exhibit unique receptor binding profiles compared to known, naturally occurring vascular endothelial growth factors.

86 Claims, 7 Drawing Sheets

OTHER PUBLICATIONS

Ataliotis et al., *Int Rev Cytology*, 172:95-127 (1997).
Barleon et al., *Blood*, 87:3336-3343 (1996).
Bellomo et al., *Circ Res.*, 2000; E29-E35.
Betscholtz et al., *Cell*, 39:447-57 (1984).
Birkenhager et al., *Biochemical Journal*, 316:703-707 (1996).
Cao et al., *J. Biol. Chem.*, 271:3154-62 (1996).
Chang et al., *Nature Biotechnology*, 17:793-797 (1999).
Claesson-Welsh et al., *Proc. Nat'l. Acad. Sci.* (*USA*), 86(13):4917-4921 (1989).
Claesson-Welsh et al., *Mol. Cell. Biol.*, 8:3476-3486 (1988).
Collins et al., *Nature*, 316:748-750 (1985).
Cowling and Dexter, *TIBTECH*, 10(10):349-357 (1992).
DeVries et al., *Science*, 255:989-991 (1992).
Dumont et al., *Science*, 282:946-949 (1998).
EMBL database Account No. AF091434.
Fairbrother et al., *Biochemistry*, 37(51):17754-17764 (1998).
Ferrara, *J. Mol. Med.*, 77:527-543 (1999).
Ferrara and Alitalo, *Nature Med.*, 5:1359-1364 (1999).
Ferrell et al., *Hum. Mol. Genetics*, 7:2073-78 (1998).
Folkman et al., *Proc. Nat'l. Acad. Sci.* (*USA*), 76:5217-5221 (1979).
Folkman, *Nature Med.*, 1:27-31 (1995).
Friesel et al., *FASEB J.*, 9:919-25 (1995).
Fuh et al., *J. Biol. Chem.*, 273:11197-11204 (1998).
Gnatenko et al., *J. Investig. Med.*, 45:87-98 (1997).
Harayama et al., *TIBTECH*, 16:76-82 (1998).
Hauser et al., *Growth Factors*, 9:259-268 (1993).
Hein, *Methods Enzymol.*, 183:626-645 (1990).
Heldin et al., *Growth Factors*, 8:245-252 (1993).
Heldin et al., *Biochimica et Biophysica Acta*, 1378:F79-113 (1998).
Henikoff et al., *Proc. Nat'l. Acad. Sci. USA*, 89:10915-10919 (1992).
Isner et al., *Circulation*, 91:2687-2692 (1995).
Isner et al., *Human Gene Therapy*, 7:989-1011 (1996).
Jeltsch et al., *Science*, 276:1423-1425 (1997).
Joukov et al., *The EMBO Journal*, 16(13):3898-3911 (1997).
Joukov et al., *J. Cell Physiol.*, 173:211-215 (1997).
Joukov et al., *The EMBO Journal*, 15(2):290-8 (1996).
Kaipainen et al., *Proc. Nat'l. Acad. Sci. USA*, 92:3566-3570 (1995).
Keating et al., *Science*, 239:914-916 (1988).
Keyt et al., *Journal of Biological Chemistry*, 271(10):5638-5646 (1996).
Kikuchi et al., *Gene*, 236:159-167 (1999).
Korhonen et al., *Blood*, 86(5):1828-1835 (1995).
Lambert et al., *Coron. Artery Dis.*, 4:469-475 (1993).
Lincoff et al., *Circulation*, 90:2070-2084 (1994).
Maglione et al., *Proc. Nat'l. Acad. Sci.* (*USA*), 88(20):9267-9271 (1996).
Maglione et al., *Oncogene*, 8:925-931 (1993).
Makinen et al., *J. Biol. Chem.*, 274:21217-22 (1999).
Matthews et al., *Proc. Nat'l. Acad. Sci. USA*, 88:9026-9030 (1991).
Mazur et al., *Texas Heart Institute Journal*, 21:104-111 (1994).
Meyer et al., *The EMBO Journal*, 18:363-374 (1999).
Miles and Miles, *J. Physiol.*, 118:228-257 (1952).
Muller et al., *Structure*, 5:1325-1338 (1997).
Muragaki et al., *Proc. Nat'l. Acad. Sci.* (*USA*), 92:8763-8776 (1995).
Mustonen et al., *J. Cell. Biol.*, 129:895-98 (1995).
Nachman et al., *Regul. Pept.*, 57:359-370 (1995).
Needleman et al., *J. Mol. Biol.*, 48:443-453 (1970).
Nelson et al., *J. Cell Biol.*, 97:244-251 (1983).
Oh et al., *Dev. Biol.*, 188:96-109 (1997).
Oliyai and Stella, *Ann. Rev. Pharmacol. Toxicol.*, 32:521-544 (1993).
Olofsson et al., *Proc. Nat'l. Acad. Sci.* (*USA*), 93:2576-2581 (1996).
Orlandini, S., *Proc. Nat'l. Acad. Sci.* (*USA*), 93(21):11675-11680 (1996).
Ortega et al., *Fron. Biosci.*, 4:141-152 (1999).
Ostermeier et al., *Nature Biotechnology*, 17:1205-1209 (1999).
Pajusola et al., *Oncogene*, 9:3545-3555 (1994).
Pertovaara et al., *J. Biol. Chem.*, 269:6271-74 (1994).
Petrova et al., *Exp. Cell Res.*, 253:117-130 (1999).
Risau et al., *Dev. Biol.*, 125:441-450 (1988).
Rosenfeld et al., *Cell*, 68:143-155 (1992).
Rosenkranz et al., *Growth Factors*, 16:201-16 (1999).
Schmelz et al., *Differentiation*, 57:97-117 (1994).
Shih et al., *Proc. Nat'l. Acad. Sci. USA*, 87:1436-1440 (1990).
Soker et al., *J. Biol. Chem.*, 271:5761-7 (1996).
Stacker and Achen, *Growth Factors*, 17:1-11 (1999).
Steg et al., *Circulation*, 96:408-411 (1997).
Steg et al., *Circulation*, 90:1648-1656 (1994).
Taipale et al., *Curr Top Microbiol Immunol.*, 237:85-96 (1999).
Terman et al., *Biochem Biophys Res Comm*, 187:1579-1586 (1992).
Thompson et al., *Nucl Acids Res.*, 22:4673-80 (1994).
Valtola et al., *Am. J. Path*, 154:1381-90 (1999).
Vassar et al., *Proc. Nat'l. Acad. Sci.* (*USA*), 86:1563-1567 (1989).
Vassar et al., *Genes Dev.*, 5:714-727 (1991).
Waltenberger et al., *J. Biol. Chem.*, 269:26988-26995 (1994).
Wilensky et al., *Trends Caridovasc. Med.*, 3:163-170 (1993).
Wolinsky et al., *J. Am. Coll. Cardiol.*, 15:475-481 (1990).
Zachary, *Intl J. Biochem Cell Bio*, 30:1169-1174 (1998).
Zhang et al., *Proc. Nat'l. Acad. Sci. USA*, 94:4504-09 (1997).
Breier et al., *Dev.*, 114:521-532 (1992).
Lehner et al., *J. Clin. Microbiol.*, 29:2494-2502 (1991).
Neufeld et al., *FASEB J.*, 13:9-22 (1999).

* cited by examiner

MATERIALS AND METHODS INVOLVING HYBRID VASCULAR ENDOTHELIAL GROWTH FACTOR DNAS AND PROTEINS

The present application is a divisional application of U.S. patent application Ser. No. 09/795,006, filed Feb. 26, 2001, now U.S. Pat. No. 6,965,010, which claims benefit of priority to U.S. Provisional Patent Application No. 60/205,331 filed May 18, 2000 and U.S. Provisional Patent Application No. 60/185,205 filed Feb. 25, 2000. The entire text and drawing of each of the priority applications is specifically incorporated herein by reference, without prejudice or disclaimer.

The file copy of the sequence listing is submitted on a Compact-Disc Recordable (CD-R). The sequence listing is saved as an ASCII text file named 35977B2.txt (1.58 MB), which was created on Feb. 21, 2005. The contents of the CD-R are incorporated herein by reference in its entirety.

BACKGROUND OF THE INVENTION

The PDGF proteins and their receptors (PDGFRs) are involved in regulation of cell proliferation, survival and migration of several cell types. The VEGF proteins and their receptors (VEGFRs) play important roles in both vasculogenesis, the development of the embryonic vasculature from early differentiating endothelial cells, and angiogenesis, the process of forming new blood vessels from pre-existing ones [Risau et al., *Dev Biol* 125:441-450 (1988); Zachary, *Intl J Biochem Cell Bio* 30:1169-1174 (1998); Neufeld et al., *FASEB J* 13:9-22 (1999); Ferrara, *J Mol Med* 77:527-543 (1999)]. Both processes depend on the tightly controlled endothelial cell proliferation, migration, differentiation, and survival. Dysfunction of the endothelial cell regulatory system is a key feature of cancer and several diseases associated with abnormal angiogenesis, such as proliferative retinopathies, age-related muscular degeneration, rheumatoid arthritis, and psoriasis. Understanding of the specific biological function of the key players involved in regulating endothelial cells will lead to more effective therapeutic applications to treat such diseases [Zachary, *Intl J Biochem Cell Bio* 30:1169-1174 (1998); Neufeld et al., *FASEB J* 13:9-22 (1999); Ferrara, *J Mol Med* 77:527-543 (1999)].

The PDGF/VEGF Family

The PDGF/VEGF family of growth factors includes at least the following members: PDGF-A (see e.g., GenBank Acc. No. X06374), PDGF-B (see e.g., GenBank Acc. No. M12783), VEGF (see e.g., GenBank Acc. No. Q16889 referred to herein for clarity as VEGF-A or by particular isoform), PIGF (see e.g., GenBank Acc. No. X54936 placental growth factor), VEGF-B (see e.g., GenBank Acc. No. U48801; also known as VEGF-related factor (VRF)), VEGF-C (see e.g., GenBank Acc. No. X94216; also known as VEGF related protein (VRP)), VEGF-D (also known as c-fos-induced growth factor (FIGF); see e.g., Genbank Acc. No. AJ00185), VEGF-E (also known as NZ7 VEGF or OV NZ7; see e.g., GenBank Acc. No. S67522), NZ2 VEGF (also known as OV NZ2; see e.g., GenBank Acc. No. S67520), D1701 VEGF-like protein (see e.g., GenBank Acc. No. AF106020; Meyer et al., *EMBO J* 18:363-374), and NZ10 VEGF-like protein (described in International Patent Application PCT/US99/25869) [Stacker and Achen, *Growth Factors* 17:1-11 (1999); Neufeld et al., *FASEB J* 13:9-22 (1999); Ferrara, *J Mol Med* 77:527-543 (1999)].

Members of the PDGF/VEGF family are characterized by a number of structural motifs including a conserved PDGF motif defined by the sequence: P-[PS]-C-V-X(3)-R-C-[GSTA]-G-C-C (SEQ ID NO: 1200). The brackets indicate that this position within the polypeptide can be any one of the amino acids contained within the brackets. The number contained within the parentheses indicates the number of amino acids that separate the "V" and "R" residues. This conserved motif falls within a large domain of 70-150 amino acids defined in part by eight highly conserved cysteine residues that form inter- and intramolecular disulfide bonds. This domain forms a cysteine knot motif composed of two disulfide bonds which form a covalently linked ring structure between two adjacent β strands, and a third disulfide bond that penetrates the ring [see for example, FIG. 1 in Muller et al., *Structure* 5:1325-1338 (1997)], similar to that found in other cysteine knot growth factors, e.g., transforming growth factor-β (TGF-β). The amino acid sequence of all known PDGF/VEGF proteins, with the exception of VEGF-E, contains the PDGF domain. The PDGF/VEGF family proteins are predominantly secreted glycoproteins that form either disulfide-linked or non-covalently bound homo- or heterodimers whose subunits are arranged in an anti-parallel manner [Stacker and Achen, *Growth Factors* 17:1-11 (1999); Muller et al., *Structure* 5:1325-1338 (1997)].

The PDGF Subfamily

The PDGFs regulate cell proliferation, cell survival and chemotaxis of many cell types in vitro (reviewed in [Heldin et al., *Biochimica et Biophysica Acta* 1378:F79-113 (1998)]. The two chains that make up PDGF, PDGF-A and PDGF-B, can homo- or heterodimerize producing three different isoforms: PDGF-AA, PDGF-AB, or PDGF-BB. PDGF-A is only able to bind the PDGF α-receptor (PDGFR-α), whereas PDGF-B can bind both the PDGF-α and a second PDGF receptor (PDGF-α). In vivo, the PDGF proteins exert their effects in a paracrine manner since they often are expressed in epithelial (PDGF-A) or endothelial (PDGF-B) cells in close apposition to the PDGF receptor-expressing mesenchyme (reviewed in Ataliotis et al., *Int Rev Cytology* 172:95-127 (1997)]. Overexpression of the PDGFs has been observed in several pathological conditions, including malignancies, atherosclerosis, and fibroproliferative diseases. In tumor cells and cell lines grown in vitro, co-expression of the PDGFs and PDGF receptors generates autocrine loops, which are important for cellular transformation [Betsholtz et al., *Cell* 39:447-57 (1984); Keating et al., *Science* 239:914-6 (1988)].

The importance of the PDGFs as regulators of cell proliferation and cell survival is well illustrated by recent gene targeting studies in mice. Homozygous null mutations for either PDGF-A or PDGF-B are lethal in mice. Approximately 50% of the homozygous PDGF-A deficient mice have an early lethal phenotype, while the surviving animals have a complex postnatal phenotype with lung emphysema due to improper alveolar septum formation, and a dermal phenotype characterized by thin dermis, misshapen hair follicles, and thin hair. PDGF-A is also required for normal development of oligodendrocytes and subsequent myelination of the central nervous system. The PDGF-B deficient mice develop renal, hematological and cardiovascular abnormalities; where the renal and cardiovascular defects, at least in part, are due to the lack of proper recruitment of mural cells (vascular smooth muscle cells, pericytes or mesangial cells) to blood vessels.

The VEGF Subfamily

The VEGF subfamily is composed of PDGF/VEGF members which share a VEGF homology domain (VHD) characterized by the sequence: C-X(22-24)-P-[PSR]-C-V-X(3)-

R-C-[GSTA]-G-C-C-X(6)-C-X(32-41)-C (SEQ ID NO: 1201). The VHD domain, determined through analysis of the VEGF subfamily members, comprises the PDGF motif but is more specific.

VEGF-A was originally purified from several sources on the basis of its mitogenic activity toward endothelial cells, and also by its ability to induce microvascular permeability, hence it is also called vascular permeability factor (VPF). VEGF-A has subsequently been shown to induce a number of biological processes including the mobilization of intracellular calcium, the induction of plasminogen activator and plasminogen activator inhibitor-1 synthesis, promotion of monocyte migration in vitro, induction of antiapoptotic protein expression in human endothelial cells, induction of fenestrations in endothelial cells, promotion of cell adhesion molecule expression in endothelial cells and induction of nitric oxide mediated vasodilation and hypotension [Ferrara, *J Mol Med* 77: 527-543 (1999); Neufeld et al., *FASEB J* 13: 9-22 (1999); Zachary, *Intl J Biochem Cell Bio* 30: 1169-1174 (1998)].

VEGF-A is a secreted, disulfide-linked homodimeric glycoprotein composed of 23 kD subunits. Five human VEGF-A isoforms of 121, 145, 165, 189 or 206 amino acids in length ($VEGF_{121-206}$), encoded by distinct mRNA splice variants, have been described, all of which are capable of stimulating mitogenesis in endothelial cells. However, each isoform differs in biological activity, receptor specificity, and affinity for cell surface- and extracellular matrix-associated heparan-sulfate proteoglycans, which behave as low affinity receptors for VEGF-A. $VEGF_{121}$ does not bind to either heparin or heparan-sulfate; $VEGF_{145}$ and $VEGF_{165}$ (GenBank Acc. No. M32977) are both capable of binding to heparin; and $VEGF_{189}$ and $VEGF_{206}$ show the strongest affinity for heparin and heparan-sulfates. $VEGF_{121}$, $VEGF_{145}$, and $VEGF_{165}$ are secreted in a soluble form, although most of $VEGF_{165}$ is confined to cell surface and extracellular matrix proteoglycans, whereas $VEGF_{189}$ and $VEGF_{206}$ remain associated with extracellular matrix. Both $VEGF_{189}$ and $VEGF_{206}$ can be released by treatment with heparin or heparinase, indicating that these isoforms are bound to extracellular matrix via proteoglycans. Cell-bound $VEGF_{189}$ can also be cleaved by proteases such as plasmin, resulting in release of an active soluble $VEGF_{110}$. Most tissues that express VEGF are observed to express several VEGF isoforms simultaneously, although $VEGF_{121}$ and $VEGF_{165}$ are the predominant forms, whereas $VEGF_{206}$ is rarely detected [Ferrara, *J Mol Med* 77:527-543 (1999)]. $VEGF_{145}$ differs in that it is primarily expressed in cells derived from reproductive organs [Neufeld et al., *FASEB J* 13:9-22 (1999)].

The pattern of VEGF-A expression suggests its involvement in the development and maintenance of the normal vascular system, and in angiogenesis associated with tumor growth and other pathological conditions such as rheumatoid arthritis. VEGF-A is expressed in embryonic tissues associated with the developing vascular system, and is secreted by numerous tumor cell lines. Analysis of mice in which VEGF-A was knocked out by targeted gene disruption indicate that VEGF-A is critical for survival, and that the development of the cardiovascular system is highly sensitive to VEGF-A concentration gradients. Mice lacking a single copy of VEGF-A die between day 11 and 12 of gestation. These embryos show impaired growth and several developmental abnormalities including defects in the developing cardiovasculature. VEGF-A is also required post-natally for growth, organ development, regulation of growth plate morphogenesis and endochondral bone formation. The requirement for VEGF-A decreases with age, especially after the fourth postnatal week. In mature animals, VEGF-A is required primarily for active angiogenesis in processes such as wound healing and the development of the corpus luteum. [Neufeld et al., *FASEB J* 13:9-22 (1999); Ferrara, *J Mol Med* 77:527-543 (1999)]. VEGF-A expression is influenced primarily by hypoxia and a number of hormones and cytokines including epidermal growth factor (EGF), TGF-β, and various interleukins. Regulation occurs transcriptionally and also post-transcriptionally such as by increased mRNA stability [Ferrara, *J Mol Med* 77:527-543 (1999)].

PlGF, a second member of the VEGF subfamily, is generally a poor stimulator of angiogenesis and endothelial cell proliferation in comparison to VEGF-A, and the in vivo role of PlGF is not well understood. Three isoforms of PlGF produced by alternative mRNA splicing have been described [Hauser et al., *Growth Factors* 9:259-268 (1993); Maglione et al., *Oncogene* 8:925-931 (1993)]. PlGF forms both disulfide-liked homodimers and heterodimers with VEGF-A. The PlGF-VEGF-A heterodimers are more effective at inducing endothelial cell proliferation and angiogenesis than PlGF homodimers. PlGF is primarily expressed in the placenta, and is also co-expressed with VEGF-A during early embryogenesis in the trophoblastic giant cells of the parietal yolk sac [Stacker and Achen, *Growth Factors* 17:1-11 (1999)].

VEGF-B, described in detail in International Patent Publication No. WO 96/26736 and U.S. Pat. Nos. 5,840,693 and 5,607,918, shares approximately 44% amino acid identity with VEGF-A. Although the biological functions of VEGF-B in vivo remain incompletely understood, it has been shown to have angiogenic properties, and may also be involved in cell adhesion and migration, and in regulating the degradation of extracellular matrix. It is expressed as two isoforms of 167 and 186 amino acid residues generated by alternative splicing. $VEGF-B_{167}$ is associated with the cell surface or extracellular matrix via a heparin-binding domain, whereas $VEGF-B_{186}$ is secreted. Both $VEGF-B_{167}$ and $VEGF-B_{186}$ can form disulfide-linked homodimers or heterodimers with VEGF-A. The association to the cell surface of $VEGF_{165}$-$VEGF-B_{167}$ heterodimers appears to be determined by the VEGF-B component, suggesting that heterodimerization may be important for sequestering VEGF-A. VEGF-B is expressed primarily in embryonic and adult cardiac and skeletal muscle tissues [Joukov et al., *J Cell Physiol* 173:211-215 (1997); Stacker and Achen, *Growth Factors* 17:1-11 (1999)]. Mice lacking VEGF-B survive but have smaller hearts, dysfunctional coronary vasculature, and exhibit impaired recovery from cardiac ischemia [Bellomo et al., Circ Res 2000;E29-E35].

A fourth member of the VEGF subfamily, VEGF-C, comprises a VHD that is approximately 30% identical at the amino acid level to VEGF-A. VEGF-C is originally expressed as a larger precursor protein, prepro-VEGF-C, having extensive amino- and carboxy-terminal peptide sequences flanking the VHD, with the C-terminal peptide containing tandemly repeated cysteine residues in a motif typical of Balbiani ring 3 protein. Prepro-VEGF-C undergoes extensive proteolytic maturation involving the successive cleavage of a signal peptide, the C-terminal pro-peptide, and the N-terminal pro-peptide. Secreted VEGF-C protein consists of a non-covalently-linked homodimer, in which each monomer contains the VHD. The intermediate forms of VEGF-C produced by partial proteolytic processing show increasing affinity for the VEGFR-3 receptor, and the mature protein is also able to bind to the VEGFR-2 receptor. [Joikov et al., *EMBO J.,* 16:(13):3898-3911 (1997).] It has also been demonstrated that a mutant VEGF-C, in which a single cysteine at position 156 is either substituted by another amino acid or deleted, loses the ability to bind VEGFR-2 but remains capable of binding and activating VEGFR-3 [International Patent Publication No. WO 98/33917]. In mouse embryos, VEGF-C mRNA is expressed primarily in the allantois, jugular area, and the metanephros. [Joukov et al., *J Cell Physiol* 173:211-215 (1997)]. VEGF-C is involved in the regulation of lymphatic angiogenesis: when VEGF-C was overexpressed in the skin of transgenic mice, a hyperplastic lymphatic vessel network was observed, suggesting that VEGF-C induces lymphatic growth [Jeltsch et al., *Science,* 276:1423-1425 (1997)]. Continued expression of VEGF-C in the adult also indicates a role in maintenance of differentiated lymphatic endothelium [Ferrara, *J Mol Med* 77:527-543 (1999)]. VEGF-C also shows angiogenic properties: it can stimulate migration of bovine capillary endothelial (BCE) cells in collagen and promote growth of human endothelial cells [see, e.g., International Patent Publication No. WO 98/33917, incorporated herein by reference].

VEGF-D is structurally and functionally most closely related to VEGF-C [see International Patent Publ. No. WO 98/07832, incorporated herein by reference]. Like VEGF-C, VEGF-D is initially expressed as a prepro-peptide that undergoes N-terminal and C-terminal proteolytic processing, and forms non-covalently linked dimers. VEGF-D stimulates mitogenic responses in endothelial cells in vitro. During embryogenesis, VEGF-D is expressed in a complex temporal and spatial pattern, and its expression persists in the heart, lung, and skeletal muscles in adults. Isolation of a biologically active fragment of VEGF-D designated VEGF-DΔNΔC, is described in International Patent Publication No. WO 98/07832, incorporated herein by reference. VEGF-DΔNΔC consists of amino acid residues 93 to 201 of VEGF-D linked to the affinity tag peptide FLAG®.

Four additional members of the VEGF subfamily have been identified in poxviruses, which infect humans, sheep and goats. The orf virus-encoded VEGF-E and NZ2 VEGF are potent mitogens and permeability enhancing factors. Both show approximately 25% amino acid identity to mammalian VEGF-A, and are expressed as disulfide-liked homodimers. Infection by these viruses is characterized by pustular dermititis which may involve endothelial cell proliferation and vascular permeability induced by these viral VEGF proteins. [Ferrara, *J Mol Med* 77:527-543 (1999); Stacker and Achen, *Growth Factors* 17:1-11 (1999)]. VEGF-like proteins have also been identified from two additional strains of the orf virus, D1701 [GenBank Acc. No. AF106020; described in Meyer et al., *EMBO J* 18:363-374 (1999)] and NZ10 [described in International Patent Application PCT/US99/25869, incorporated herein by reference]. These viral VEGF-like proteins have been shown to bind VEGFR-2 present on host endothelium, and this binding is important for development of infection and viral induction of angiogenesis [Meyer et al., *EMBO J* 18:363-374 (1999); International Patent Application PCT/US99/25869].

PDGF/VEGF Receptors

Seven cell surface receptors that interact with PDGF/VEGF family members have been identified. These include PDGFR-α (see e.g., GenBank Acc. No. NM006206), PDGFR-β (see e.g., GenBank Acc. No. NM002609), VEGFR-1/Flt-1 (fms-like tyrosine kinase-1; GenBank Acc. No. X51602; De Vries et al., *Science* 255:989-991 (1992)); VEGFR-2/KDR/Flk-1 (kinase insert domain containing receptor/fetal liver kinase-1; GenBank Acc. Nos. X59397 (Flk-1) and L04947 (KDR); Terman et al., *Biochem Biophys Res Comm* 187:1579-1586 (1992); Matthews et al., *Proc Natl Acad Sci USA* 88:9026-9030 (1991)); VEGFR-3/Flt4 (fms-like tyrosine kinase 4; U.S. Pat. No. 5,776,755 and GenBank Acc. No. X68203 and S66407; Pajusola et al., *Oncogene* 9:3545-3555 (1994)), neuropilin-1 (Gen Bank Acc. No. NM003873), and neuropilin-2 (Gen Bank Acc. No. NM003872). The two PDGF receptors mediate signaling of PDGFs as described above. $VEGF_{121}$, $VEGF_{165}$, VEGF-B, PlGF-1 and PlGF-2 bind VEGF-R1; $VEGF_{121}$, $VEGF_{145}$, $VEGF_{165}$, VEGF-C, VEGF-D, VEGF-E, and NZ2 VEGF bind VEGF-R2; VEGF-C and VEGF-D bind VEGFR-3; $VEGF_{165}$, PlGF-2, and NZ2 VEGF bind neuropilin-1; and $VEGF_{165}$ binds neuropilin-2. [Neufeld et al., *FASEB J* 13:9-22 (1999); Stacker and Achen, *Growth Factors* 17:1-11 (1999); Ortega et al., *Fron Biosci* 4:141-152 (1999); Zachary, *Intl J Biochem Cell Bio* 30:1169-1174 (1998); Petrova et al., *Exp Cell Res* 253:117-130 (1999)].

The PDGF receptors are protein tyrosine kinase receptors (PTKs) that contain five immunoglobulin-like loops in their extracellular domains. VEGFR-1, VEGFR-2, and VEGFR-3 comprise a subgroup of the PDGF subfamily of PTKs, distinguished by the presence of seven Ig domains in their extracellular domain and a split kinase domain in the cytoplasmic region. Both neuropilin-1 and neuropilin-2 are non-PTK VEGF receptors. NP-1 has an extracellular portion includes a MAM domain; regions of homology to coagulation factors V and VIII, MFGPs and the DDR tyrosine kinase; and two CUB-like domains.

Several of the VEGF receptors are expressed as more than one isoform. A soluble isoform of VEGFR-1 lacking the seventh Ig-like loop, transmembrane domain, and the cytoplasmic region is expressed in human umbilical vein endothelial cells. This VEGFR-1 isoform binds VEGF-A with high affinity and is capable of preventing VEGF-A-induced mitogenic responses [Ferrara, *J Mol Med* 77:527-543 (1999); Zachary, *Intl J Biochem Cell Bio* 30:1169-1174 (1998)]. A C-terminal truncated from of VEGFR-2 has also been reported [Zachary, *Intl J Biochem Cell Bio* 30:1169-1174 (1998)]. In humans, there are two isoforms of the VEGFR-3 protein which differ in the length of their C-terminal ends. Studies suggest that the longer isoform is responsible for most of the biological properties of VEGFR-3.

The receptors for the PDGFs, PDGF α-receptor (PDGFR-α) and the β-receptor (PDGFR-β), are expressed by many in vitro grown cell lines, and they are mainly expressed by mesenchymal cells in vivo (reviewed in [Raines et al., Peptide growth factors and their receptors, Heidelberg, Springer-Verlag (1990)]. As mentioned above, PDGF-B binds both PDGFRs, while PDGF-A selectively binds PDGFR-α.

Gene targeting studies in mice have revealed distinct physiological roles for the PDGF receptors despite the overlapping ligand specificities of the PDGFRs [Rosenkranz et al., *Growth Factors* 16:201-16 (1999)]. Homozygous null mutations for either of the two PDGF receptors are lethal. PDGFR-α deficient mice die during embryogenesis at e10, and show incomplete cephalic closure, impaired neural crest development, cardiovascular defects, skeletal defects, and odemas. The PDGFR-β deficient mice develop similar phenotypes to animals deficient in PDGF-B, that are characterized by renal, hematological and cardiovascular abnormalities; where the renal and cardiovascular defects, at least in part, are due to the lack of proper recruitment of mural cells (vascular smooth muscle cells, pericytes or mesangial cells) to blood vessels.

The expression of VEGFR-1 occurs mainly in vascular endothelial cells, although some may be present on monocytes, trophoblast cells, and renal mesangial cells [Neufeld et al., *FASEB J* 13:9-22 (1999)]. High levels of VEGFR-1 mRNA are also detected in adult organs, suggesting that VEGFR-1 has a function in quiescent endothelium of mature vessels not related to cell growth. VEGFR-1–/– mice die in utero between day 8.5 and 9.5. Although endothelial cells developed in these animals, the formation of functional blood vessels was severely impaired, suggesting that VEGFR-1 may be involved in cell-cell or cell-matrix interactions associated with cell migration. Recently, it has been demonstrated that mice expressing a mutated VEGFR-1 in which only the tyrosine kinase domain was missing show normal angiogenesis and survival, suggesting that the signaling capability of VEGFR-1 is not essential. [Neufeld et al., *FASEB J* 13:9-22 (1999); Ferrara, *J Mol Med* 77:527-543 (1999)].

VEGFR-2 expression is similar to that of VEGFR-1 in that it is broadly expressed in the vascular endothelium, but it is also present in hematopoietic stem cells, megakaryocytes, and retinal progenitor cells [Neufeld et al., *FASEB J* 13:9-22 (1999)]. Although the expression pattern of VEGFR-1 and VEGFR-2 overlap extensively, evidence suggests that, in most cell types, VEGFR-2 is the major receptor through which most of the VEGFs exert their biological activities. Examination of mouse embryos deficient in VEGFR-2 further indicate that this receptor is required for both endothelial cell differentiation and the development of hematopoietic cells [Joukov et al., *J Cell Physiol* 173:211-215 (1997)].

VEGFR-3 is expressed broadly in endothelial cells during early embryogenesis. During later stages of development, the expression of VEGFR-3 becomes restricted to developing lymphatic vessels [Kaipainen, A., et al., *Proc. Natl. Acad. Sci. USA,* 92: 3566-3570 (1995)]. In adults, the lymphatic endothelia and some high endothelial venules express VEGFR-3, and increased expression occurs in lymphatic sinuses in metastatic lymph nodes and in lymphangioma. VEGFR-3 is also expressed in a subset of $CD34^+$ hematopoietic cells which may mediate the myelopoietic activity of VEGF-C demonstrated by overexpression studies [WO 98/33917]. Targeted disruption of the VEGFR-3 gene in mouse embryos leads to failure of the remodeling of the primary vascular network, and death after embryonic day 9.5 [Dumont et al., Science, 282: 946-949 (1998)]. These studies suggest an essential role for VEGFR-3 in the development of the embryonic vasculature, and also during lymphangiogenesis.

Structural analyses of the VEGF receptors indicate that the VEGF-A binding site on VEGFR-1 and VEGFR-2 is located in the second and third Ig-like loops. Similarly, the VEGF-C and VEGF-D binding sites on VEGFR-2 and VEGFR-3 are also contained within the second Ig-loop [Taipale et al., *Curr Top Microbiol Immunol* 237:85-96 (1999)]. The second Ig-like loop also confers ligand specificity as shown by domain swapping experiments [Ferrara, *J Mol Med* 77:527-543 (1999)]. Receptor-ligand studies indicate that dimers formed by the VEGF family proteins are capable of binding two VEGF receptor molecules, thereby dimerizing VEGF receptors. The fourth Ig-like loop on VEGFR-1, and also possibly on VEGFR-2, acts as the receptor dimerization domain that links two receptor molecules upon binding of the receptors to a ligand dimer [Ferrara, *J Mol Med* 77:527-543(1999)]. Although the regions of VEGF-A that bind VEGFR-1 and VEGFR-2 overlap to a large extent, studies have revealed two separate domains within VEGF-A that interact with either VEGFR-1 or VEGFR-2, as well as specific amino acid residues within these domains that are critical for ligand-receptor interactions. Mutations within either VEGF receptor-specific domain that specifically prevent binding to one particular VEGF receptor have also been recovered [Neufeld et al., *FASEB J* 13:9-22 (1999)].

VEGFR-1 and VEGFR-2 are structurally similar, share common ligands ($VEGF_{121}$, and $VEGF_{165}$), and exhibit similar expression patterns during development. However, the signals mediated through VEGFR-1 and VEGFR-2 by the same ligand appear to be slightly different. VEGFR-2 has been shown to undergo autophosphorylation in response to VEGF-A, but phosphorylation of VEGFR-1 under identical conditions was barely detectable. VEGFR-2 mediated signals cause striking changes in the morphology, actin reorganization, and membrane ruffling of porcine aortic endothelial cells recombinantly overexpressing this receptor. In these cells, VEGFR-2 also mediated ligand-induced chemotaxis and mitogenicity; whereas VEGFR-1-transfected cells lacked mitogenic responses to VEGF-A. Mutations in VEGF-A that disrupt binding to VEGFR-2 fail to induce proliferation of endothelial cells, whereas VEGF-A mutants that are deficient in binding VEGFR-1 are still capable of promoting endothelial proliferation. Similarly, VEGF stimulation of cells expressing only VEGFR-2 leads to a mitogenic response whereas comparable stimulation of cells expressing only VEGFR-1 also results in cell migration, but does not induce cell proliferation. In addition, phosphoproteins co-precipitating with VEGFR-1 and VEGFR-2 are distinct, suggesting that different signaling molecules interact with receptor-specific intracellular sequences.

The emerging hypothesis is that the primary function of VEGFR-1 in angiogenesis may be to negatively regulate the activity of VEGF-A by binding it and thus preventing its interaction with VEGFR-2, whereas VEGFR-2 is thought to be the main transducer of VEGF-A signals in endothelial cells. In support of this hypothesis, mice deficient in VEGFR-1 die as embryos while mice expressing a VEGFR-1 receptor capable of binding VEGF-A but lacking the tyrosine kinase domain survive and do not exhibit abnormal embryonic development or angiogenesis. In addition, analyses of VEGF-A mutants that bind only VEGFR-2 show that they retain the ability to induce mitogenic responses in endothelial cells. However, VEGF-mediated migration of monocytes is dependent on VEGFR-1, indicating that signaling through this receptor is important for at least one biological function. In addition, the ability of VEGF-A to prevent the maturation of dendritic cells is also associated with VEGFR-1 signaling, suggesting that VEGFR-1 may function in cell types other than endothelial cells. [Ferrara, *J Mol Med* 77:527-543 (1999); Zachary, *Intl J Biochem Cell Bio* 30:1169-1174 (1998)].

Neuropilin-1 was originally cloned as a receptor for the collapsin/semaphorin family of proteins involved in axon guidance [Stacker and Achen, *Growth Factors* 17:1-11 (1999)]. It is expressed in both endothelia and specific subsets of neurons during embryogenesis, and it thought to be involved in coordinating the developing. neuronal and vascular system. Although activation of neuropilin-1 does not appear to elicit biological responses in the absence of the VEGF family tyrosine-kinase receptors, their presence on cells leads to more efficient binding of $VEGF_{165}$ and VEGFR-2 mediated responses. [Neufeld et al., *FASEB J* 13:9-22 (1999)] Mice lacking neuropilin-1 show abnormalities in the developing embryonic cardiovascular system. [Neufeld et al., *FASEB J* 13:9-22 (1999)]

Neuropilin-2 was identified by expression cloning and is a collapsin/semaphorin receptor closely related to neuropilin-1. Neuropilin-2 is an isoform-specific VEGF receptor in that it only binds $VEGF_{165}$. Like neuropilin-1, neuropilin-2 is expressed in both endothelia and specific neurons, and is not predicted to function independently due to its relatively short intracellular domain. The function of neuropilin-2 in vascular development is unknown [Neufeld et al., *FASEB J* 13:9-22 (1999); WO 99/30157].

Therapeutic Applications for VEGF Polypeptides and Antagonists

The discovery of VEGF-A as a key regulator of vascular development has spurred active research using VEGF-based therapeutic angiogenesis in cardiovascular medicine, as well as for treating diseases characterized by pathological angiogenesis with VEGF antagonists. Subsequent identification of additional VEGF family proteins and their roles in vascularization have also led to the development of therapies based on these growth factors [Ferrara and Alitalo, *Nature Med* 5:1359-1364 (1999)]. Animal studies of hindlimb ischemia, and myocardial ischemia using VEGF-A or VEGF-C, delivered by administration of recombinant protein or gene transfer using naked DNA or adenoviral vectors, implicate these molecules in promoting vascularization and increasing coronary blood flow. These promising results have led to clinical trials in which patients with limb ischemia were treated by arterial or intramuscular gene transfer of naked DNA encoding $VEGF_{165}$. Patients with myocardial ischemia or Burger's disease (thromboangiitis obliterans) were also injected locally with $VEGF_{165}$ plasmid DNA. Although these trials were not placebo-controlled, the patients showed clinical improvement and evidence of angiogenesis in ischemic tissues. Trials using gene transfer of VEGF-C naked DNA or gene therapy with $VEGF_{121}$ using adenoviral vectors to treat patients with myocardial ischemia are currently in Phase I [Ferrara, *J Mol Med* 77:527-543 (1999); Neufeld et al., *FASEB J* 13:9-22 (1999); Ferrara and Alitalo, *Nature Med* 5:1359-1364 (1999)]. The therapeutic effects of administering recombinant VEGF-A protein are also being tested in ongoing clinical trials. Results from a Phase I study of patients with coronary ischemia treated with intracoronary infusion of recombinant $VEGF_{165}$ show evidence of improved perfusion and collateralization. However, in the subsequent Phase II study, the patients did not show significant improvement over the placebo-controlled group. Other potential therapeutic uses for VEGF growth factors include using VEGF-C to promote lymphangiogenesis in patients whose axillary lymph nodes were removed during breast carcinoma surgery. Therapies using combinations of growth factors to promote vascularization in tissues may also prove to be preferable in treating certain diseases [Ferrara and Alitalo, *Nature Med* 5:1359-1364 (1999)].

Therapies based on inhibiting the activity of VEGF growth factors are being tested to treat disease states characterized by pathological angiogenesis. VEGF expression is upregulated in most human tumors including primary breast cancer and gastric carcinoma. Studies in mice indicate that tumor-associated angiogenesis and growth of the tumor cells can be inhibited by treating the animals with monoclonal antibodies against VEGF-A. Further animal studies showed that expression of a dominant negative VEGFR-2 mutant that prevents signaling through this receptor, or administration of recombinant VEGFR-1 or VEGFR-2 mutants, which only contain the extracellular portion of these receptors, suppresses growth of several tumor cell lines. These encouraging results led to clinical trials using humanized high affinity monoclonal antibodies against VEGF-A (rhuMAb VEGF) as VEGF-A inhibitors. Phase II studies using rhuMAb VEGF to treat non-small cell lung carcinoma, colorectal carcinoma, breast, and renal cell carcinoma are currently ongoing. Compounds targeting inhibition of VEGF-C activity are also being tested for therapeutic uses in cancer patients: small molecule inhibitors of VEGF-C are in Phase II trials, and monoclonal antibodies against VEGF-C are entering clinical trials.

Retinopathy associated with diabetes mellitus, occlusion of central retinal vein or prematurity has been correlated with increased levels of VEGF-A. Animal studies using monoclonal antibodies against VEGF-A or soluble VEGFR-1 or VEGFR-2 mutants containing only the extracellular domain fused to immunoglobulin γFc domain show suppression of retinal angiogenesis. VEGF-A is also detected in age-related macular degeneration (AMD), and its expression is thought to be the cause of neovascularization in this disease. Intravitreal delivery of recombinant humanized anti-VEGF-A Fab antibody fragment or injection of 2'-fluoropyrimidine RNA oligonucleotide ligands (aptamers) to treat AMD are currently in clinical trials. Compounds that inhibit the activity of VEGF growth factors may also be used to treat other disease states involving abnormal angiogenesis. These include ischemic-reperfusion related brain edema and injury, conditions associated with ovarian hyperplasia and hypervascularity such as the polycystic ovary syndrome, endometriosis, and ovarian hyperstimulation syndrome [Ferrara and Alitalo, *Nature Med* 5:1359-1364 (1999)].

From the foregoing discussion, it will be apparent that the VEGF family of growth factors, and inhibitors thereof, have tremendous potential as therapeutics. For example, such growth factors and inhibitors are useful to promote or inhibit angiogenesis where needed, such as in the treatment of ischemic disorders, the promotion of wound healing, or the inhibition or elimination of neoplastic disorders that are angiogenesis-dependent. However, the various naturally-occurring members of this growth factor family often bind multiple receptors, and the various known receptors are expressed on multiple cell types and have expression patterns that may vary depending on stage of development and the presence or absence of pathological conditions. The biological effects of any particular growth factor may be receptor-dependent, isoform dependent, and cell-type dependent. A desirable therapeutic effect mediated through one receptor may be accompanied by undesirable side-effects mediated through another receptor. Alternatively, a desirable therapeutic effect might be enhanced through stimulation of multiple receptors that cannot be stimulated with any single known growth factor that occurs in nature. Therefore, a need exists for novel peptide growth factors with their own unique profile of receptor binding and receptor-stimulating or receptor-inhibiting activities.

SUMMARY OF THE INVENTION

The present invention satisfies needs identified above by providing novel polypeptide binding molecules for naturally occurring vascular endothelial growth factor receptors, and polynucleotides that encode the novel polypeptides and are useful for recombinant expression of the polypeptides. For the purpose of describing the invention, the term "vascular endothelial growth factor" and the abbreviation "VEGF"

(without modifier) are used herein in a generic sense, to describe any of a family of growth factor polypeptides including but not limited to Vascular Endothelial Growth Factor-A (VEGF-A), Vascular Endothelial Growth Factor-B (VEGF-B), Vascular Endothelial Growth Factor-C (VEGF-C), Vascular Endothelial Growth Factor-D (VEGF-D), Platelet Derived Growth Factor-A (PDGF-A), Platelet Derived Growth Factor-B (PDGF-B), Placenta Growth Factor (PlGF), and virally encoded VEGF-like molecules. VEGF-A is commonly referred to in the art as "Vascular Endothelial Growth Factor" or as "VEGF," but for clarity shall be referred to herein as VEGF-A or referred to as specific isoforms (e.g., $VEGF_{165}$) of VEGF-A.

For example, in one aspect, the invention provides a chimeric polypeptide comprising a plurality of peptide subunits derived from two or more naturally-occurring vertebrate vascular endothelial growth factor polypeptides that have different vascular endothelial growth factor receptor binding profiles, wherein the chimeric polypeptide binds at least one receptor of one of the naturally-occurring vascular endothelial growth factor polypeptides, and wherein the chimeric polypeptide has a different receptor binding profile than the naturally-occurring growth factor polypeptides. Isolated and purified chimeric polypeptides are preferred.

In this context, the term "naturally-occurring vertebrate vascular endothelial growth factor polypeptides" means polypeptides having the following characteristics:

(1) the polypeptide is encoded by genomic DNA of a vertebrate (e.g., a reptile, amphibian, bird, or mammal, preferably a bird or mammal, most preferably a mammal; especially a primate mammal such as a monkey, ape, or human) or is encoded by the genome of a vertebrate pathogen such as mammalian pox viruses;

(2) the polypeptide comprises all or a portion of an amino acid sequence that is expressed by a vertebrate (i.e., from transcription/translation of the vertebrate's genomic DNA or from virally-induced transcription/translation, in the case of polypeptides encoded by viral nucleic acids);

(3) the polypeptide or portion comprises a VEGF/PDGF homology domain (V/PHD) of about 70-150 amino acids that binds to naturally-occurring receptors and that is characterized in part by the amino acid motif: C-X(18-28)-P-X-C-X(4)-R-C-X-G-C(1-2)-X(6-12)-C-X(30-46)-C (SEQ ID NO: 1202), where X represents any amino acid and numbers in parentheses represent a permissible range of amino acids (e.g., X(18-28) represents a stretch of any 18-28 amino acids; C(1-2) represents one or two cysteine residues). The V/PHD usually includes eight conserved cysteines which form a cysteine knot motif similar to that found in human Vascular Endothelial Growth Factors A, B, C, and D (VEGF-A, -B, -C, and -D), and human platelet-derived growth factors (PDGFs). Preferred polypeptides or portions comprise a V/PHD that is characterized by the more particular amino acid motif C-X(22-24)-P-[PSR]-C-V-X(3)-R-C-X-G-C-C-X(6)-C-X(32-41)-C (SEQ ID NO: 1203), where amino acids in brackets (e.g., [PSR]) represent alternatives for a single position in the amino acid sequence; and (4) the polypeptide binds to at least one cell surface receptor that is expressed on endothelial cells that line vertebrate blood or lymphatic vessels or pericytes/smooth muscle cells that line and support blood vessels. Preferred polypeptides bind to a least one cell surface receptor that is expressed on endothelial cells.

Thus, the term "naturally-occurring vertebrate VEGF polypeptides" means polypeptides that have certain specified structural and functional properties. The term is not intended in this context to imply a source of origin. Thus, recombinantly produced polypeptides that satisfy the above criteria because they have an amino acid sequences and receptor binding properties of VEGF polypeptides that exist in nature are considered "naturally-occurring". Numerous exemplary naturally occurring vascular endothelial growth factor polypeptides are already known in the art, including but not limited to human Vascular Endothelial Growth Factor-A (VEGF-A), Vascular Endothelial Growth Factor-B (VEGF-B), Vascular Endothelial Growth Factor-C (VEGF-C), Vascular Endothelial Growth Factor-D (VEGF-D), Platelet Derived Growth Factor-A (PDGF-A), Platelet Derived Growth Factor-B (PDGF-B), Placenta Growth Factor (PlGF); mammalian and avian orthologs thereof (where the term "ortholog" means species homolog); and Vascular Endothelial Growth Factor E (VEGF-E), NZ2 VEGF, and the two VEGF-like proteins identified in strains D1701 and NZ10, which have been identified in poxviruses. The use of naturally occurring human VEGF's is preferred for the purposes of developing chimeric molecules that are useful as human therapeutics, in order to minimize the likelihood of developing chimerics that generate an immune response in humans. However, in many cases there is very high homology between VEGF species orthologs, especially in receptor binding domains, and it is contemplated that non-human naturally occurring VEGFs also can be used to generate chimeric molecules for use in treating humans. Although the invention is described herein in part with reference to particular VEGF-A/VEGF-C chimeric polypeptides, chimeric polypeptides derived from any pair, or three, or four, or more of the VEGFs described herein or their species orthologs is particularly contemplated.

As used to describe this aspect of the invention, the term "chimeric requires that the amino acid sequence of the chimeric molecule include at least one stretch of one or more amino acids (preferably stretches of 1, 2, 3, 4, 5, 6, 7, 8, 9, 10, 11, 12, 13, 14, 15, 16, 17, 18, 19, 20, or more amino acids) from each of the naturally-occurring VEGF's from which it was derived. Thus, the chimeric polypeptide is a "hybrid" or "mosaic" of two or more polypeptides. By "chimeric" is meant that the polypeptide of the invention is not identical to any naturally occurring VEGF sequence (or fragment of a natural VEGF sequence).

As used to describe this aspect of the invention, the term "derived from" " (as in "derived from two or more naturally occurring VEGF polypeptides") means that, when the amino acid sequences of the chimeric polypeptide and the two or more naturally occurring VEGF's are aligned using a standard algorithm, substantially all of the amino acids in the chimeric polypeptide are aligned with an identical residue in one or more of the naturally occurring VEGF's from which the chimeric was derived. Standard protein alignment algorithms, for example, the clustral method [*Nucl Acids Res* 22:4673-80 (1994)], the Jotun-Hein method [*Methds Enzymol* 183:626-645 (1990)], or the Feng-Doolittle method [*J Mol Evol* 25:351-360 (1987)], can be used to align naturally-occurring vertebrate vascular endothelial growth factor polypeptides, such alignments being greatly facilitated by the presence of the eight highly conserved cysteines dispersed through the V/PHD. Thus, it is readily established that a chimeric polypeptide is "derived from" two or more naturally occurring VEGF's by performing an alignment using any generally accepted protein alignment algorithm. If, after aligning the amino acid sequences of a chimeric polypeptide and two or more naturally occurring VEGF's using any standard algorithm, substantially all of the amino acids in the chimeric polypeptide are aligned with an identical residue in one or more of the naturally occurring VEGF's, then the chimeric polypeptide was derived from the naturally occurring VEGFs. In one embodiment, all of the amino acids of the chimeric molecule will align in this manner. However, the use of the term "substantially all" reflects the fact that techniques described herein for making chimeric polypeptides will sometimes introduce mutations such as insertions, deletions, or substitutions, preventing 100% correlation to parent sequences. In such cases, at least about 90%, 92%, 94%, 95%. 96%, 97%, 98%, or 99% of the residues of the chimeric polypeptide will align with identical residues from at least one of the natural VEGF's.

When presented with a chimeric polypeptide of the invention that aligns perfectly or substantially with the natural VEGF polypeptides from which it was derived, it is within the skill of the art to intentionally introduce mutations (especially conserved mutations) into the chimeric polypeptide and test such a modified chimeric polypeptide for its receptor binding profile. Modifications of chimeric polypeptides (especially conserved amino acid substitutions) that do not introduce substantial changes in receptor binding profile are intended as equivalents within the scope of the present invention.

In the context of such chimeric polypeptides, the term "plurality of peptide subunits" means two or more peptide subunits. Exemplified herein are chimeric polypeptides obtained by fragmenting two naturally occurring VEGF cDNA's (human VEGF-A and human VEGF-C) into nine subunits of about 8-16 codons each, recombining these fragments into all 512 permutations of the nine subunits (maintaining subunit order), and expressing the resultant chimeric cDNAs. The number and the size of fragments is not intended as a critical feature. In preferred embodiments, plurality comprises 2, 3, 4, 5, 6, 7, 8, 9, 10, 11, 12, 13, 14, 15, 16, 17, 18, 19, 20, 21, 22, 23, 24, or 25 or more subunits. As exemplified herein, the "subunits" are joined by peptide bonds to form a polypeptide chain.

In the context of chimeric polypeptides of the invention or naturally occurring VEGF polypeptides, determination of "vascular endothelial growth factor receptor binding profile" means the determination of the receptors to which a polypeptide will bind and the receptors to which it will not. Known VEGF receptors, including VEGFR-1, VEGFR-2, and VEGFR-3, are described in greater detail elsewhere herein. Known PDGF receptors are also described in greater detail elsewhere herein. Where a chimeric polypeptide has been derived in part from a naturally occurring PDGF sequence, screening the chimeric polypeptide for binding to PDGF receptors is contemplated as part of the receptor binding profile determination.) By way of example, if a chimeric polypeptide was derived from a VEGF-A that binds to VEGFR-1 and VEGFR-2 and from a VEGF-C that binds to VEGFR-2 and VEGFR-3, the chimeric polypeptide has a different receptor binding profile than either of its parent molecules if it binds to only one of the three receptors, or if it binds to all three receptors, or if it binds to VEGFR-1 and VEGFR-3 but not VEGFR-2. In one preferred embodiment, the invention provides chimeric polypeptides wherein the chimeric polypeptide binds to at least two VEGF receptors bound by the two or more naturally occurring vertebrate VEGF polypeptides, and wherein each of the naturally-occurring VEGF polypeptides from which the chimeric polypeptide was derived fail to bind to one or more of the at least two VEGF polypeptides.

Screening polypeptides of the invention for binding to the neuropilins NP-1 and NP-2 are not contemplated as part of the receptor binding profile determination, because the portions of VEGF (and other family members) responsible for NP-1 and NP-2 binding are portions outside of the V/PHD core region. NP-1 binding is mediated by amino acid residues 142 to 185 of SEQ ID NO: 2 for VEGF-A, and amino acid residues 138 to 182 for VEGF-B [Soker et al., *J Biol Chem* 271:5761-7 (1996); Makinen et al., *J Biol Chem* 274:21217-22 (1999)]. As explained below, addition of upstream or downstream sequences to chimeric polypeptides of the invention is contemplated, and some added sequences are contemplated to result in NP-1 or NP-2 binding.

The present invention is believed to provide the first disclosure of a polypeptide that is capable of binding to all of VEGFR-1, VEGFR-2, and VEGFR-3. All polypeptides having this receptor binding profile are intended as within the scope of the invention.

Naturally occurring VEGF polypeptides generally bind their respective receptors with high affinity, which is generally understood in this context to mean binding with a sub-nanomolar dissociation constant. For example, VEGF-A binds VEGFR-1 and VEGFR-2 with Kd of approximately 16 pM and 760 pM, respectively; and VEGF-C binds VEGFR-2 and VEGFR-3 with Kd of approximately 410 pM and 135 pM, respectively. Because it is possible to administer a therapeutic growth factor protein to achieve concentrations exceeding normal serum concentrations, and to formulate such polypeptides to increase biological half-life, it is contemplated that chimeric polypeptides having less receptor affinity (i.e., higher dissociation constants) nonetheless will be useful as receptor agonists and antagonists. For the purposes of scoring receptor binding of chimeric polypeptides, a 50 nanomolar dissociation constant cutoff is selected. Chimeric polypeptides that bind a receptor with a dissociation constant of less than 50 nanomolar as determined by any conventional and recognized method, such as those described in Coligan et al., *Current Protocols in Protein Science*, Vol. 2, New York, John Wiley & Sons, Inc., p. A.5A.1-A.5A.40 (1998), incorporated herein by reference, is scored as binding to a receptor, and polypeptides with lower affinities are scored as non-binding.

It is well known in the literature that naturally occurring VEGF's are expressed as splice variants and/or as preprotein molecules and/or as prepro-protein molecules that undergo proteolytic processing. Chimeric polypeptides of the invention include chimeric (hybrid) receptor binding domains as explained in the preceding paragraphs, and optionally may include additional upstream or downstream sequences from naturally occurring VEGF's, including upstream and downstream sequences that are present in mature isoforms of naturally occurring circulating VEGF's; and/or upstream or downstream pro-peptide sequences that are removed during normal intracellular or extracellular processing. By way of illustration, the chimeric polypeptides described in Example 1 were prepared using residues 34-135 (SEQ ID NO: 2) of VEGF-A and using 112-216 of human prepro-VEGF-C (SEQ ID NO: 22). Chimeric polypeptides of the invention include the peptides actually exemplified, and also include such peptides modified by the addition of upstream or downstream VEGF-A or VEGF-C sequences from SEQ ID NOs: 2 or 22. With respect to VEGF-A/VEGF-C chimeric polypeptides as exemplified herein, the addition of upstream and downstream sequences that correspond with amino- and/or carboxyl-terminal sequences characteristic of natural VEGF-A or VEGF-C isoforms is particularly contemplated.

It is also well known in the literature to recombinantly express proteins with an initiator methionine, with a heterologous signal peptide, with one or more tag sequences to facilitate purification, as fusions with other polypeptides, and the like. It is also well known to modify polypeptides with glycosylation, pegylation, or other modifications, some of which improve stability, circulating half-life, or (in the case of glycosylation) may make the polypeptide more similar to endogenous vascular endothelial growth factors. Chimeric polypeptides according to the invention may comprise any such modifications and additions to the amino acid sequence derived from two or more naturally-occurring vertebrate vascular endothelial growth factor polypeptides.

In addition to chimeric molecules having different receptor binding profiles, an additional aspect of the invention includes chimeric molecules having increased receptor binding affinity. For example, the invention provides a chimeric polypeptide comprising a plurality of peptide subunits derived from two or more naturally-occurring vertebrate vascular endothelial growth factor polypeptides, wherein the chimeric polypeptide binds at least one naturally-occurring vascular endothelial growth factor receptor with an increased binding affinity compared to the binding affinity of the two or more naturally-occurring vascular endothelial growth factors for the receptor. Chimeric molecules that bind a receptor with greater affinity than naturally occurring VEGF's are among the preferred chimeric molecules of the invention, even if the receptor binding profile for the chimeric molecules is identical to that of a naturally occurring VEGF. Increased receptor binding affinity is expected to correlate with great potency as receptor activators or inhibitors. Generally, dissociation constants ($K_d$) determined by any accepted procedure are indicative of receptor affinity, with lower $K_d$ indicative of greater binding affinity. Particularly contemplated are chimeric molecules that display any reduction in $K_d$ that is statistically significant at a level of $p<0.05$ in side-by-side tests [see, e.g., Coligan et al., *Current Protocols in Protein Science*, Vol. 2, New York, John Wiley & Sons, Inc., p. A.5A.1-A.5A.40 (1998)] compared to naturally-occurring molecules from which the chimera was derived. Chimeras that show a twenty percent reduction in $K_d$ (i.e., increased binding affinity) with respect to a VEGF receptor are preferred. Reductions of 33% or 50% are highly preferred. A 3-fold reduction (e.g., a $K_d$ of 33.3 pM for a chimeric polypeptide compared to a 100 pM $K_d$ of a naturally occurring VEGF), 5-fold reduction, 10-fold reduction, or 20-fold reduction in dissociation constants or is very highly preferred.

Another related preferred class of chimeric molecules are those molecules that display any reduction in $EC_{50}$ concentration that is statistically significant at a level of $p<0.05$ in side-by-side tests compared to naturally-occurring molecules from which the chimera was derived. Chimeras that show a twenty percent reduction in $EC_{50}$ (i.e., increased binding affinity) with respect to a VEGF receptor are preferred. Reductions of 33% or 50% are highly preferred. $EC_{50}$, or the half effective concentration, is the concentration that produces 50% of a maximal effect. An exemplary assay for determining the $EC_{50}$ of a putative ligand for a specific receptor is set forth in Example 6, below.

The Examples set forth below provide a description of the synthesis and assaying of numerous specific hybrid polypeptides of the invention, every one of which is itself intended as an aspect of the invention. A preferred group of hybrid polypeptides from among the exemplified polypeptides are polypeptides that comprise an amino acid sequence of the formula:

$$NH_2\text{-}X_1\text{-}X_2\text{-}X_3\text{-}X_4\text{-}X_5\text{-}X_6\text{-}X_7\text{-}X_8\text{-}X_9\text{-}COOH$$

wherein $X_1$ comprises an amino acid sequence selected from the group consisting of amino acids 3-11 of SEQ ID NO: 128 and amino acids 3-11 of SEQ ID NO:137; wherein $X_2$ comprises an amino acid sequence selected from the group consisting of SEQ ID NOs: 129 and 138; wherein $X_3$ comprises an amino acid sequence selected from the group consisting of SEQ ID NOs: 130 and 139; wherein $X_4$ comprises an amino acid sequence selected from the group consisting of SEQ ID NOs: 131 and 140; wherein $X_5$ comprises an amino acid sequence selected from the group consisting of SEQ ID NOs: 132 and 141; wherein $X_6$ comprises an amino acid sequence selected from the group consisting of SEQ ID NOs: 133 and 142; wherein $X_7$ comprises an amino acid sequence selected from the group consisting of SEQ ID NOs: 134 and 143; wherein $X_8$ comprises an amino acid sequence selected from the group consisting of SEQ ID NOs: 135 and 144; wherein $X_9$ comprises an amino acid sequence selected from the group consisting of SEQ ID NOs: 136 and 145; wherein $NH_2\text{-}X_1\text{-}X_2\text{-}X_3\text{-}X_4\text{-}X_5\text{-}X_6\text{-}X_7\text{-}X_8\text{-}X_9\text{-}COOH$ is not identical to amino acids 34 to 135 of SEQ ID NO: 2 or amino acids 112 to 216 of SEQ ID NO: 22; and wherein the polypeptide binds to at least one receptor selected from the group consisting of human VEGFR-1, human VEGFR-2, and human VEGFR-3. As described below in greater detail, each of the specified amino acid sequence pairs (e.g., SEQ ID NO: 128 and 137) are encoded by a VEGF-A cDNA fragment or a VEGF-C cDNA fragment that align with each other when the receptor binding domains of VEGF-A and VEGF-C are aligned to maximize sequence homology, using standard alignment algorithms.

With respect to the foregoing genus of hybrid of polypeptides, one preferred subgenus comprises those polypeptides which bind to exactly one receptor selected from the group consisting of human VEGFR-1, human VEGFR-2, and human VEGFR-3. Initial screens suggest that the following specific constructs (described below in detail) satisfy this criteria: 82-14, 82-16, 22-3, 72-6, 12-14, 12-16, 32-9, 32-11, 32-14, 32-15, 32-16, 52-9, 52-11, 52-14, 52-15, 14-7, 23-10, 23-12, 23-14, 33-1, 33-3, 33-6, 33-9, 53-1, 53-3, 53-7, 62-8, 62-10, 62-13, 63-3, 63-6, 73-7, 73-15, -8, 74-10, 74-12, 11-9, 11-13, 12-1, 12-5, 81-9, 81-13, 13-9, 13-11, 13-13, 13-15, 14-1, 14-5, 41-1, 43-1, 83-9, 83-13, 83-15, 61-1, 61-3, 62-1, 82-5, 84-1, 84-5.

Another preferred subgenus comprises those hybrid polypeptides that bind to VEGFR-1 and VEGFR-3, but not to VEGFR-2. Initial screens suggest that the following specific constructs satisfy this criteria: 12-9, 12-13, 14-9, 82-9, 82-13, 84-9.

A highly preferred subgenus comprises hybrid polypeptides of the invention that bind VEGFR-1, VEGFR-2, and VEGFR-3. Initial screens suggest that the following specific constructs satisfy this criteria: 12-7, 12-11, 82-11, 84-11.

Other subgenuses include hybrid polypeptides that bind VEGFR-1 and VEGFR-2 (both of which are bound by VEGF-A) but not VEGFR-3; and hybrid polypeptides that bind VEGFR-2 and VEGFR-3 (both of which are bound by fully processed VEGF-C) but not VEGFR-1.

As taught in greater detail below, the fourth fragment ($X_4$) appears to include residues that are important for conferring VEGFR-3 binding affinity. For this reason, another preferred genus of the hybrid polypeptides are those wherein $X_4$ comprises SEQ ID NO: 140, and wherein the polypeptide binds to VEGFR-3. Fragments 5 and 8 of VEGF-C also appear to contribute to VEGFR-3 binding. Thus, highly preferred are polypeptides further characterized by $X_5$ comprising SEQ ID NO: 141, and/or $X_8$ comprising SEQ ID NO: 144.

Similarly, the data below suggests that fragments 2 and 7 of VEGF-A contribute to VEGF-R1 binding. Thus, another preferred gene of the hybrid polypeptides are those wherein $X_2$ comprises SEQ ID NO: 129, and wherein the polypeptide binds to VEGFR-1. In a highly preferred embodiment, $X_7$ comprises SEQ ID NO: 134. In an embodiment where it is desirous for this polypeptide also to bind to VEGFR-3, a preferred construct is one wherein $X_4$ comprises SEQ ID NO: 140. To confer VEGFR-3 binding, it is still more preferable for $X_5$ to comprise SEQ ID NO: 141, and/or for $X_8$ to comprise SEQ ID NO: 144.

The recombination experiments described below to generate hybrid molecules were performed only with receptor binding domains of human VEGF-A and VEGF-C, rather than with sequences corresponding to natural secreted forms of VEGF-A and VEGF-C or pre-protein or prepro-protein sequences. However, routine recombinant DNA techniques, such as those described in Ausubel, et al. (Eds.), *Protocols in Molecular Biology*, John Wiley & Sons (1994-1999) or Sambrook et al., (Eds.), *Molecular Cloning: A Laboratory Manual*, Cold Spring Harbor Laboratory Press: Cold Spring Harbor, N.Y. (1989), can be used to join polynucleotides encoding the hybrid proteins with polynucleotides encoding VEGF-A or VEGF-C sequences that are found upstream or downstream of the receptor binding domain in naturally-occurring proteins, especially sequences found in naturally-occurring secreted and circulating forms of VEGF-A or VEGF-C.

Thus, the invention provides a polypeptide comprising an amino acid sequence of the formula $X_N$-V/PHD-$X_C$, wherein $X_N$ is selected from the group consisting of amino acids 1-34 of SEQ ID NO: 2, amino acids 1-111 of SEQ ID NO: 22, amino acids 1-34 of SEQ ID NO: 147, or fragments thereof;

wherein V/PHD is a chimeric polypeptide as described elsewhere herein;

wherein $X_C$ is selected from the group consisting of amino acids 136-191 of SEQ ID NO: 2, amino acids 217-419 of SEQ ID NO: 22, amino acids 136-232 of SEQ ID NO: 147, or fragments thereof; and wherein $X_N$ and $X_C$ are each identical to amino acid sequence in a naturally occurring human VEGF-A or VEGF-C precursor protein or a naturally occurring human VEGF-A or VEGF-C isoform.

In one specific variation, the invention provides hybrid polypeptides as described above, wherein the polypeptide further includes one or more amino acid sequences selected from the group consisting of a prepro-VEGF-C signal peptide, a prepro-VEGF-C amino-terminal propeptide, and a prepro-VEGF-C carboxy-terminal pro-peptide.

Expression of hybrid polypeptides of the invention is not restricted to expression only with naturally-occurring flanking VEGF-A or VEGF-C sequences, however. Expression of polypeptides of the invention in bacteria may be accomplished by including an initiator methionine or methionine-lysine upstream of the hybrid VEGF sequences, whereas expression and secretion in mammalian cells is most conveniently accomplished by including at least a signal peptide. Thus, in one embodiment, the invention provides a polypeptide as described above, wherein the polypeptide further includes an amino terminal methionine residue or an amino-terminal Met-Lys sequence. In another embodiment, the polypeptide further includes a signal peptide amino acid sequence connected to the amino acid sequence of the formula $NH_2$-$X_1$-$X_2$-$X_3$-$X_4$-$X_5$-$X_6$-$X_7$-$X_8$-$X_9$-COOH.

Expression of polypeptides of the invention as fusions with other heterologous sequences, such as tag sequences to facilitate purification or expression as part of larger fusion peptides also is contemplated. An exemplary tag of this type is a poly-histidine sequence, generally around six histidine residues, that permits isolation of a compound so labeled using nickel chelation. Other labels and tags, such as the FLAG® tag (Eastman Kodak, Rochester, N.Y.), well known and routinely used in the art, are embraced by the invention. Exemplary fusions include use of commercially available vectors that express a desired polypeptide as part of glutathione-S-transferase (GST) fusion product. After cleavage of the GST component from the desired polypeptide, an additional glycine residue at position-1 may remain. Variants which result from expression in other vector systems are also contemplated.

By virtue of the receptor binding and activity assays described herein, the present application also provides variants (analogs) of the hybrid polypeptides of the invention, wherein one or more amino acids of the hybrid peptide amino acid sequence has been added, deleted, or substituted by another amino acid, and wherein the hybrid retains the receptor binding and/or a biological activity characteristic of the hybrid polypeptide.

Substitution variants wherein merely conservative substitutions have been introduced (e.g., by modification of polynucleotides encoding polypeptides of the invention) are intended as equivalents of hybrid polypeptides of the invention. Amino acids can be classified according to physical properties and contribution to secondary and tertiary protein structure. A conservative substitution is recognized in the art as a substitution of one amino acid for another amino acid that has similar properties. Exemplary conservative substitutions based on amino acid side chain properties are set out in the table immediately below, using standard one letter abbreviations.

| SIDE CHAIN CHARACTERISTIC | AMINO ACID |
|---|---|
| Aliphatic | |
| Non-polar | G, A, P, I, L, V |
| Polar - uncharged | C, S, T, M, N, Q |
| Polar - charged | D, E, K, R |
| Aromatic | F, W, Y |
| Other | N, Q, D, E |

Alternatively, conservative amino acids can be grouped as described in Lehninger, [*Biochemistry*, Second Edition; Worth Publishers, Inc. NY: N.Y. (1975), pp.71-77] as set out in the table immediately below.

| | |
|---|---|
| Non-polar (hydrophobic) side chain | |
| Aliphatic: | A, L, I, V, P |
| Aromatic: | F, W |
| Sulfur-containing: | M |
| Borderline: | G |
| Uncharged-polar side chain | |
| Hydroxyl: | S, T, Y |
| Amides: | N, Q |

-continued

| | |
|---|---|
| Sulfhydryl: | C |
| Borderline: | G |
| Positively Charged (Basic): | K, R, H |
| Negatively Charged (Acidic): | D, E |

The following table provides still an another alternative, exemplary set of conservative amino acid substitutions. Both one letter and three letter abbreviations are shown:

| Original Residue | Conservative Substitutions |
|---|---|
| Ala (A) | Val, Leu, Ile |
| Arg (R) | Lys, Gln, Asn |
| Asn (N) | Gln, His, Lys, Arg |
| Asp (D) | Glu |
| Cys (C) | Ser |
| Gln (Q) | Asn |
| Glu (E) | Asp |
| His (H) | Asn, Gln, Lys, Arg |
| Ile (I) | Leu, Val, Met, Ala, Phe, |
| Leu (L) | Ile, Val, Met, Ala, Phe |
| Lys (K) | Arg, Gln, Asn |
| Met (M) | Leu, Phe, Ile |
| Phe (F) | Leu, Val, Ile, Ala |
| Pro (P) | Gly |
| Ser (S) | Thr |
| Thr (T) | Ser |
| Trp (W) | Tyr |
| Tyr (Y) | Trp, Phe, Thr, Ser |
| Val (V) | Ile, Leu, Met, Phe, Ala |

For many proteins, the effects of any individual or small group of amino acid changes is unlikely to significantly alter biological properties, especially if the changes are conservative substitutions, provided the changes are not introduced at critical residues. Preferred variants of the hybrid polypeptides of the invention share at least about 70%, 80%, 90%, 95%, 96%, 97%, 98%, or 99% amino acid identity with hybrids that consist entirely of amino acid sequences derived from naturally occurring VEGF's.

Identity and similarity of related nucleic acid molecules and polypeptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math., 48: 1073 (1988).

Preferred methods to determine identity and/or similarity are designed to give the largest match between the sequences tested. Methods to determine identity and similarity are described in publicly available computer programs. Preferred computer program methods to determine identity and similarity between two sequences include, but are not limited to, the GCG program package, including GAP (Devereux et al., Nucl. Acid. Res., 12:387 (1984); Genetics Computer Group, University of Wisconsin, Madison, Wis.), BLASTP, BLASTN, and FASTA (Altschul et al., J. Mol. Biol., 215:403-410 (1990)). The BLASTX program is publicly available from the National Center for Biotechnology Information (NCBI) and other sources (BLAST Manual, Altschul et al. NCB/NLM/NIH Bethesda, Md. 20894; Altschul et al., supra). The well known Smith Waterman algorithm may also be used to determine identity.

Preferred parameters for a polypeptide sequence comparison include the following:

Algorithm: Needleman et al., J. Mol. Biol., 48, 443-453 (1970);

Comparison matrix: BLOSUM 62 from Henikoff et al., Proc. Natl. Acad. Sci. USA, 89: 10915-10919 (1992);

Gap Penalty: 12

Gap Length Penalty: 4

Threshold of Similarity: 0

Preferred parameters for nucleic acid molecule sequence comparisons include the following:

Algorithm: Needleman et al., J. Mol Biol., 48: 443-453 (1970);

Comparison matrix: matches=+10, mismatch=0

Gap Penalty: 50

Gap Length Penalty: 3

Thus, in still another embodiment, the invention provides a polypeptide comprising a non-naturally occurring vascular endothelial growth factor amino acid sequence, wherein said non-naturally occurring vascular endothelial growth factor amino acid sequence consists of an amino acid sequence that is at least 95% identical to an amino acid sequence of the formula:

$$NH_2\text{-}X_1\text{-}X_2\text{-}X_3\text{-}X_4\text{-}X_5\text{-}X_6\text{-}X_7\text{-}X_8\text{-}X_9\text{-}COOH$$

wherein $X_1$ comprises an amino acid sequence selected from the group consisting of amino acids 3-11 of SEQ ID NO: 128 and amino acids 3-11 of SEQ ID NO: 137; wherein $X_2$ comprises an amino acid sequence selected from the group consisting of SEQ ID NOs: 129 and 138; wherein $X_3$ comprises an amino acid sequence selected from the group consisting of SEQ ID NOs: 130 and 139; wherein $X_4$ comprises an amino acid sequence selected from the group consisting of SEQ ID NOs: 131 and 140; wherein $X_5$ comprises an amino acid sequence selected from the group consisting of SEQ ID NOs: 132 and 141; wherein $X_6$ comprises an amino acid sequence selected from the group consisting of SEQ ID NOs: 133 and 142; wherein $X_7$ comprises an amino acid sequence selected from the group consisting of SEQ ID NOs: 134 and 143; wherein $X_8$ comprises an amino acid sequence selected from the group consisting of SEQ ID NOs: 135 and 144; wherein $X_9$ comprises an amino acid sequence selected from the group consisting of SEQ ID NOs: 136 and 145; and wherein the polypeptide binds to at least one receptor selected from the group consisting of human VEGFR-1, human VEGFR-2, and human VEGFR-3. In a preferred embodiment, $NH_2\text{-}X_1\text{-}X_2\text{-}X_3\text{-}X_4\text{-}X_5\text{-}X_6\text{-}X_7\text{-}X_8\text{-}X_9\text{-}COOH$ is not identical to amino acids 34 to 135 of SEQ ID NO: 2 or amino acids 112 to 216 of SEQ ID NO: 22.

By "non-naturally occurring vascular endothelial growth factor amino acid sequence" is meant a sequence that is not identical to any known, naturally occurring amino acid sequence, such as, in this case, receptor binding domains from known VEGF-A or VEGF-C sequences.

Stated more generally, the invention provides a polypeptide that comprises an amino acid sequence that is at least about 70%, 80%, 90%, 95%, 96%, 97%, 98%, or 99% identical to any specific amino acid sequence of the invention, and that binds at least one of the naturally-occurring vascular endothelial growth factor or platelet derived growth factor receptors, and that has a different receptor binding profile or an improved receptor binding affinity than a naturally-occurring growth factor polypeptide. Polypeptides that satisfy the percent identity criteria and that display the same receptor binding profile as the referent polypeptide are especially contemplated. For example, the invention provides a polypeptide that comprises an amino acid sequence that is at least about 70%, 80%, 90%, 95%, 96%, 97%, 98%, or 99% identical to the amino acid sequences encoded by constructs 12-7 (SEQ ID NO: 63), 12-11 (SEQ ID NO: 71), 82-11, or 84-11, wherein the polypeptide binds VEGFR-1, VEGFR-2, and VEGFR-3.

In yet another aspect, the invention provides a dimeric protein molecule comprising a first polypeptide associated with a second polypeptide, wherein at least one of the polypeptides is a polypeptide according to the present invention. The association between the polypeptides may be by way of covalent bonding (e.g., disulfide bonding) or non-covalent bonding of polypeptide chains (e.g, hydrogen bonding, bonding due to stable or induced dipole-dipole interactions, bonding due to hydrophobic or hydrophilic interactions, combinations of these bonding mechanisms, and the like).

In another embodiment, the invention provides polynucleotides (e.g., cDNA, cDNA with introns introduced to facilitate expression in eukaryotic systems, synthetic DNA, RNA, or combinations thereof, single or double stranded) that comprise a nucleotide sequence encoding the amino acid sequence of the polypeptides of the invention. Purified and isolated polynucleotides are preferred. Due to the well-known degeneracy of the genetic code, several polynucleotides sequences exist that encode each polypeptide amino acid sequence of the invention. Such polynucleotides are useful for recombinantly expressing the polypeptides of the invention.

The invention also embraces polynucleotides that encode VEGF receptor binding polypeptides and that hybridize under moderately stringent or high stringency conditions to the complete non-coding strand, or complement, of the polynucleotides specifically described herein that encode VEGF receptor binding polypeptides. This genus of polynucleotides embraces polynucleotides that encode polypeptides with one or a few amino acid differences (additions, insertions, or deletions) relative to amino acid sequences specifically taught herein. Such changes are easily introduced by performing site directed mutagenesis, for example, or by substituting a fragment from a non-human ortholog VEGF-A or VEGF-C polypeptide for a fragment of a human VEGF-A or VEGF-C polypeptide used to construct the hybrid polypeptides of the invention.

Exemplary highly stringent hybridization conditions are as follows: hybridization at 65° C. for at least 12 hours in a hybridization solution comprising 5×SSPE, 5× Denhardt's, 0.5% SDS, and 2 mg sonicated non-homologous DNA per 100 ml of hybridization solution; washing twice for 10 minutes at room temperature in a wash solution comprising 2×SSPE and 0.1% SDS; followed by washing once for 15 minutes at 65° C. with 2×SSPE and 0.1% SDS; followed by a final wash for 10 minutes at 65° C. with 0.1×SSPE and 0.1% SDS. Moderate stringency washes can be achieved by washing with 0.5×SSPE instead of 0.1×SSPE in the final 10 minute wash at 65° C. Low stringency washes can be achieved by using 1×SSPE for the 15 minute wash at 65° C., and omitting the final 10 minute wash. It is understood in the art that conditions of equivalent stringency can be achieved through variation of temperature and buffer, or salt concentration as described Ausubel, et al. (Eds.), *Protocols in Molecular Biology*, John Wiley & Sons (1994), pp. 6.0.3 to 6.4.10. Modifications in hybridization conditions can be empirically determined or precisely calculated based on the length and the percentage of guanosine/cytosine (GC) base pairing of the probe. The hybridization conditions can be calculated as described in Sambrook et al., (Eds.), *Molecular Cloning: A Laboratory Manual*, Cold Spring Harbor Laboratory Press: Cold Spring Harbor, N.Y. (1989), pp. 9.47 to 9.51. For example, the invention provides a polynucleotide that comprises a nucleotide sequence that hybridizes under moderately stringent or high stringency hybridization conditions to any specific nucleotide sequence of the invention, and that encodes a polypeptide that binds at least one of the naturally-occurring vascular endothelial growth factor or platelet derived growth factor receptors, and that has a different receptor binding profile or an improved receptor binding affinity than a naturally-occurring growth factor polypeptide. Polynucleotides that satisfy the hybridization criteria and that display the same receptor binding profile as the referent polynucleotide are especially contemplated. For example, the invention provides a polynucleotide that comprises a nucleotide sequence that hybridizes under moderately stringent or high stringency hybridization conditions to the nucleotide sequences taught herein for constructs 12-7 (SEQ ID NO: 62), 12-11 (SEQ ID NO: 70), 82-11, or 84-11, wherein the polynucleotide encodes a polypeptide that binds VEGFR-1, VEGFR-2, and VEGFR-3.

In a related embodiment, the invention provides a polynucleotide that comprises a nucleotide sequence that is at least 80%, 85%, 90%, 95%, 97%, 98%, or 99% identical to any specific nucleotide sequence of the invention, and that encodes a polypeptide that binds at least one of the naturally-occurring vascular endothelial growth factor or platelet derived growth factor receptors, and that has a different receptor binding profile or an improved receptor binding affinity than a naturally-occurring growth factor polypeptide. Polynucleotides that satisfy the percent identity criteria and that display the same receptor binding profile as the referent polynucleotide are especially contemplated. For example, the invention provides a polynucleotide that comprises a nucleotide sequence that is at least 95% identical to the nucleotide sequences taught herein for constructs 12-7 (SEQ ID NO: 62), 12-11 (SEQ ID NO: 70), 82-11, or 84-11, wherein the polynucleotide encodes a polypeptide that binds VEGFR-1, VEGFR-2, and VEGFR-3.

In a related embodiment, the invention provides vectors comprising a polynucleotide of the invention. Such vectors are useful, e.g., for amplifying the polynucleotides in host cells to create useful quantities thereof. In preferred embodiments, the vector is an expression vector wherein the polynucleotide of the invention is operatively linked to a polynucleotide comprising an expression control sequence. Autonomously replicating recombinant expression constructs such as plasmid and viral DNA vectors incorporating polynucleotides of the invention are specifically contemplated. Expression control DNA sequences include promoters, enhancers, and operators, and are generally selected based on the expression systems in which the expression construct is to be utilized. Preferred promoter and enhancer sequences are generally selected for the ability to increase gene expression, while operator sequences are generally selected for the ability to regulate gene expression. Expression vectors are useful for recombinant production of polypeptides of the invention. Expression constructs of the invention may also include sequences encoding one or more selectable markers that permit identification of host cells bearing the construct. Expression constructs may also include sequences that facilitate, and preferably promote, homologous recombination in a host cell. Preferred constructs of the invention also include sequences necessary for replication in a host cell.

Vectors also are useful for "gene therapy" treatment regimens, wherein a polynucleotide that encodes a polypeptide of the invention is introduced into a subject in need of treatment involving the modulation (stimulation or blockage) of vascular endothelial growth factor receptors, in a form that causes cells in the subject to express the polypeptide of the invention in vivo.

In another related embodiment, the invention provides host cells, including prokaryotic and eukaryotic cells, that are transformed or transfected (stably or transiently) with polynucleotides of the invention or vectors of the invention. Polynucleotides of the invention may be introduced into the host cell as part of a circular plasmid, or as linear DNA comprising an isolated protein coding region or a viral vector. Methods for introducing DNA into the host cell well known and routinely practiced in the art include transformation, transfection, electroporation, nuclear injection, or fusion with carriers such as liposomes, micelles, ghost cells, and protoplasts. As stated above, such host cells are useful for amplifying the polynucleotides and also for expressing the polypeptides of the invention encoded by the polynucleotide. Such host cells are useful in assays as described herein. For expression of polypeptides of the invention, any host cell is acceptable, including but not limited to bacterial, yeast, plant, invertebrate (e.g., insect), vertebrate, and mammalian host cells. For developing therapeutic preparations, expression in mammalian cell lines, especially human cell lines, is preferred. Use of mammalian host cells is expected to provide for such post-translational modifications (e.g., glycosylation, truncation, lipidation, and phosphorylation) as may be desirable to confer optimal biological activity on recombinant expression products of the invention. Glycosylated and non-glycosylated forms of polypeptides are embraced by the present invention. Similarly, the invention further embraces polypeptides described above that have been covalently modified to include one or more water soluble polymer attachments such as polyethylene glycol, polyoxyethylene glycol, or polypropylene glycol.

Polypeptides of the invention also may be chemically synthesized.

In still another related embodiment, the invention provides a method for producing a vascular endothelial growth factor receptor binding protein, comprising the steps of growing a host cell of the invention in a nutrient medium and isolating the polypeptide or variant thereof from the cell or the medium. Isolation of the polypeptide from the cells or from the medium in which the cells are grown is accomplished by purification methods known in the art, e.g., conventional chromatographic methods including immunoaffinity chromatography, receptor affinity chromatography, hydrophobic interaction chromatography, lectin affinity chromatography, size exclusion filtration, cation or anion exchange chromatography, high pressure liquid chromatography (HPLC), reverse phase HPLC, and the like. Still other methods of purification include those wherein the desired protein is expressed and purified as a fusion protein having a specific tag, label, or chelating moiety that is recognized by a specific binding partner or agent. The purified protein can be cleaved to yield the desired protein, or be left as an intact fusion protein. Cleavage of the fusion component may produce a form of the desired protein having additional amino acid residues as a result of the cleavage process.

Also within the scope of the invention are compositions comprising polypeptides or polynucleotides of the invention. In a preferred embodiment, such compositions comprise one or more polynucleotides or polypeptides of the invention that have been formulated with a pharmaceutically acceptable (e.g., sterile and non-toxic) diluent or carrier. Liquid, semisolid, or solid diluents that serve as pharmaceutical vehicles, excipients, or media are preferred. Any diluent known in the art may be used. Exemplary diluents include, but are not limited to, water, saline solutions, polyoxyethylene sorbitan monolaurate, magnesium stearate, methyl- and propylhydroxybenzoate, talc, alginates, starches, lactose, sucrose, dextrose, sorbitol, mannitol, glycerol, calcium phosphate, mineral oil, and cocoa butter. Such formulations are useful, e.g., for administration of polypeptides or polynucleotides of the invention to mammalian (including human) subjects in therapeutic regimens.

Similarly, the invention provides for the use of polypeptides or polynucleotides of the invention in the manufacture of a medicament for the treatment of disorders described herein, including but not limited to disorders characterized by undesirable endothelial cell proliferation and/or disorders characterized by ischemia and/or vessel occlusion, wherein neovascularization is desirable.

In a related embodiment, the invention provides a kit comprising a polynucleotide, polypeptide, or composition of the invention packaged in a container, such as a vial or bottle, and further comprising a label attached to or packaged with the container, the label describing the contents of the container and providing indications and/or instructions regarding use of the contents of the container to treat one or more disease states as described herein.

In yet another aspect, the present invention provides methods of producing polypeptides having novel VEGF receptor binding and stimulation properties, and methods for producing polynucleotides that encodes such polypeptides. For example, the invention provides a method for making a polynucleotide that encodes a polypeptide that modulates the growth of mammalian endothelial cells or mammalian pericytes/smooth muscle cells; comprising the steps of: preparing polynucleotides that encode amino acid fragments of at least two vertebrate vascular endothelial growth factor polypeptides; commingling the polynucleotides under conditions wherein the polynucleotides recombine to form hybrid polynucleotides; expressing the hybrid polynucleotides to make hybrid polypeptides encoded by the hybrid polynucleotides; screening the hybrid polypeptides to identify a hybrid polypeptide that binds to a receptor for a vertebrate vascular endothelial growth factor; and selecting the polynucleotide that encodes the hybrid polypeptide that binds to the receptor in the screening step. Expression of the selected polynucleotide (to produce the desired polypeptide) also is contemplated.

In this context, "modulate the growth of mammalian endothelial cells" means stimulate such growth by inducing a mitogenic signal through binding cell surface receptors expressed on vascular endothelial cells, or inhibiting such growth. As explained elsewhere herein, inhibition may be due to blockage of vascular endothelial growth factor receptors, or the formation of heterodimers with endogenous growth factors that prevent stimulation of endogenous receptors by the endogenous growth factors. Inhibition also may be achieved by conjugating cytotoxic agents to polypeptides of the invention that bind VEGF receptors. Exemplary toxins are known in the art and described elsewhere herein. Polypeptides of the invention conjugated to cytotoxic agents or other agents that modulate cell growth are contemplated as another aspect of the invention.

In this context, "vertebrate vascular endothelial growth factor polypeptides" again means polypeptides having the following characteristics:

(1) the polypeptide is encoded by genomic DNA of a vertebrate (e.g., a reptile, amphibian, bird, or mammal, preferably a bird or mammal, most preferably a mammal; especially a primate mammal such as a monkey, ape, or human) or is encoded by the genome of a vertebrate pathogen such as mammalian pox viruses;

(2) the polypeptide comprises all or a portion of a coding sequence that is expressed by a vertebrate (i.e., from transcription/translation of the vertebrate's genomic DNA or from virally-induced transcription/translation, in the case of polypeptides encoded by viral nucleic acids);

(3) the polypeptide or portion comprises a VEGF homology domain (V/PHD) of about 70-150 amino acids that binds to naturally occurring receptors and that is characterized in part by the amino acid motif: C-X(18-28)-P-X-C-X(4)-R-C-X-G-C(1-2)-X(6-12)-C-X(30-46)-C, where X represents any amino acid and numbers in parentheses represent a permissible range of amino acids (e.g., X(18-28) represents a stretch of any 18-28 amino acids; C(1-2) represents one or two cysteine residues). The V/PHD includes eight conserved cysteines which form a cysteine knot motif similar to that found in human vascular endothelial growth factors A, B, C, and D (VEGF-A, -B, -C, and -D, and human platelet-derived growth factor (PDGF). Preferred polypeptides or portions comprise a VPHD that is characterized by the more particular amino acid motif C-X(22-24)-P-[PSR]-C-V-X(3)-R-C-X-G-C-C-X(6)-C-X(32-41)-C, where amino acids in brackets (e.g., [PSR]) represent alternatives for a single position in the amino acid sequence; and (4) the polypeptide binds to at least one cell surface receptor that is expressed on endothelial cells that line vertebrate blood or lymphatic vessels or pericytes/smooth muscle cells that line and support blood vessels. Preferred polypeptides bind to a least one cell surface receptor that is expressed on endothelial cells.

Several methods exist for practicing the preparing step. In one variation, single-stranded oligonucleotides are prepared based on knowledge of mammalian VEGF polypeptide sequences and the universal genetic code and using conventional chemical synthesis techniques. Example 1 below demonstrates such a technique, wherein synthetic oligonucleotide pairs were prepared and annealed to prepare double-stranded polynucleotides having single-stranded cohesive ends that encoded fragments of human VEGF-A and human VEGF-C. In another variation, cDNAs or genomic DNAs (preferably cDNAs) encoding natural VEGF's are fragmented using one or more restriction endonucleases, using DNaseI, or using Exonuclease III. [See, e.g., Chang et al., *Nature Biotechnology,* 17: 793-797 (1999) (DNaseI procedure); Kikuchi et al., *Gene,* 236: 159-167 (1999) (restriction endonuclease procedure); Harayama et al., *TIBTECH,* 16: 76-82 (1998) (review); Patten et al., *Curr. Opin. Biotechnology,* 8: 724-733 (1997) (review, DNase I); Zhang et al., *Proc. Natl. Acad. Sci. USA,* 94: 4504-09 (1997) (DNase I procedure); Stemmer, *Proc. Natl. Accd. Sci. USA,* 91: 10747-1074 (1997) (DNase I procedure); Stemmer, *Nature,* 370: 389-391 (1994) (DNase I procedure); and Ostermeier et al., *Nature Biotechnology,* 17: 1205-1209 (1999) (ExoIII procedure), all incorporated herein by reference in their entirety]. In still another variation, a cDNA (coding or non-coding strand) is used as a template to synthesize complementary fragments, using DNA polymerase and chain-termination reagents. [See, e.g., Lehtovaara et al., Protein Engineering, 2: 63-68 (1988), incorporated by reference.]

Several methods also exist for practicing the comingling step. In one variation, the polynucleotides are prepared with complementary cohesive single-stranded ends, to facilitate annealing of fragments in a desired order under conventional annealing and ligation conditions for polynucleotides. Example 1 below provides a demonstration of this technique to generate 510 human VEGF-A/VEGF-C hybrids. Such a technique also may be suitable for annealing fragment mixtures of two or more VEGF cDNAs that have been digested with restriction endonucleases. Alternatively, the commingling step is accomplished by mixing the polynucleotides and subjecting them to a self-priming PCR reaction that involves successive steps of denaturation, annealing, and extension. [See, e.g., Chang et al (1999); Kikuchi et al. (1999); Patten et al. (1997); Zhang et al. (1997); Stemmer *Proc. Natl. Accd. Sci. USA,* 91: 10747-1074 (1994); and Stemmer, *Nature,* 370: 389-391 (1994).]. Optionally, the PCR is performed under conditions that introduce errors (mutations) in the PCR products. Such mutations introduce additional molecular variation, and are expected to reduce the overall percentage of biologically active molecules, but also may produce molecules with unexpectedly superior activities.

After synthesizing the hybrid DNA molecules, the molecules are expressed by any means known in the art. In one variation the molecules are cloned into expression vectors, which are in turn used to transform or transfect cells to express the polypeptides. In another variation, the polynucleotides are cloned into a phage display vector system for screening. [See, e.g., Chang et al (1999).] The screening assay may entail a direct receptor binding assay as described below in Example 3. Alternatively, receptor binding may be assayed indirectly by assaying for a biological activity induced by receptor binding. Thus, in one variation, the screening step comprises contacting the hybrid polypeptide to a cell that expresses the receptor, wherein changes in cell growth or cell survival induced by the hybrid polypeptide is indicative of binding between the hybrid polypeptide and the receptor.

In a preferred variation of the method, the screening and selecting steps are designed to select polynucleotides that encode polypeptides that have novel receptor binding profiles not possessed by the naturally occurring VEGFs from which the polypeptide was derived. For example, the method is practiced wherein the screening step comprises screening to identify a hybrid polypeptide that binds human VEGFR-1 and human VEGFR-3, and the selecting step comprises selecting a hybrid polypeptide that binds human VEGFR-1 and human VEGFR-3, but fails to bind human VEGFR-2. Alternatively, the method is practiced whereby the screening step comprises screening to identify a hybrid polypeptide that binds human VEGFR-1, VEGFR-2, and human VEGFR-3, and the selecting step comprises selecting a hybrid polypeptide that binds human VEGFR-1, VEGFR-2, and human VEGFR-3.

In a related embodiment, the invention provides a method for making a polynucleotide that encodes a polypeptide that modulates the growth of mammalian endothelial cells, comprising the steps of: (a) preparing a set of polynucleotide fragments having the following characteristics: (i) the set includes a first subset of coding polynucleotide fragments, wherein each coding polynucleotide fragment of the first subset encodes at least four amino acids of the amino acid sequence of a first mammalian vascular endothelial growth factor; (ii) the set includes a second subset of coding polynucleotide fragments, wherein each coding polynucleotide fragment of the second subset encodes at least four amino acids of the amino acid sequence of a second mammalian vascular endothelial growth factor; (b) commingling the polynucleotide fragments which comprise the set under conditions wherein the coding polynucleotide fragments from the first and second subsets recombine to form hybrid polynucleotides; (c) expressing the hybrid polynucleotides to make hybrid polypeptides encoded by the hybrid polynucleotides; (d) screening the hybrid polypeptides to identify a hybrid polypeptide that modulates the growth of mammalian endothelial cells; and (e) selecting the polynucleotide that encodes the hybrid polypeptide that modulates the growth of mammalian endothelial cells in the screening step.

Practice of these methods of generating hybrid polynucleotides using mammalian vascular endothelial growth factors that comprise a receptor binding domain characterized by eight cysteines that are conserved in human Vascular Endothelial Growth Factor A (VEGF-A), human Vascular Endothelial Growth Factor B (VEGF-B), human Vascular Endothelial Growth Factor C (VEGF-C), and human Vascular Endothelial Growth Factor D (VEGF-D) is preferred. Exemplary starting molecules include VEGF-A VEGF-B, VEGF-C, VEGF-D, VEGF-E, PlGF, PDGF-A, and PDGF-B polypeptides of human and other mammals. Also included is the recently described protein, fallotein, disclosed in the EMBL database (Acc. No. AF091434) (SEQ ID NO: 149), which has structural characteristics of the PDGF/VEGF family of growth factors. Thus, it is also contemplated to use fallotein in generating hybrid proteins together with other mammalian VEGFs.

The polynucleotide and encoded polypeptide products of the foregoing methods are themselves considered to be additional aspects of the present invention.

Antibodies that may be generated against polypeptides of the invention, and that bind polypeptides of the invention with an affinity greater than for any natural occurring VEGF, also are contemplated as aspects of the invention. Polypeptides comprising the antigen-binding fragments of such antibodies also are contemplated as an aspect of the invention. Antibodies that bind to the polypeptides of the invention but not to vertebrate VEGF's are contemplated.

In yet another embodiment, the invention provides numerous in vitro and in vivo methods of using polypeptides and polynucleotides of the invention. Such methods are described in greater detail below in the Detailed Description. Generally speaking, polypeptides of the invention are useful for modulating (stimulating or inhibiting) cellular processes that are mediated through any of the PDGF/VEGF family of receptors, such as PDGFR-α, PDGFR-β, VEGFR-1, VEGFR-2, and/or VEGFR-3. These receptors may be involved singularly in certain processes and in combination, to varying extents, in other processes. Polypeptides of the invention possess many different receptor binding profiles, and one of the advantages of the invention is the ability to select a polypeptide with a receptor binding profile that matches the receptor expression profile of the biological process to be modulated.

Thus, in one variation, the invention provides a method of modulating the signaling of one or more of PDGFR-α, PDGFR-β, VEGFR-1, VEGFR-2, and/or VEGFR-3 in a cell, comprising the step of contacting a cell that expresses one or more of PDGFR-α, PDGFR-β, VEGFR-1, VEGFR-2, and/or VEGFR-3 with a composition comprising a polypeptide of the invention. In one variation, modulation to activate signaling is contemplated, and the cell is contacted with a polypeptide of the invention that stimulates receptor signaling in an amount sufficient to bind to the one or more receptors and induce receptor signaling. In another variation, modulation to inhibit signaling is contemplated. The cell is contacted with a polypeptide that inhibits ligand-induced receptor activation (or a polypeptide conjugated to a cytotoxin), in an amount sufficient to inhibit signaling that is induced by receptor ligand growth factor polypeptides that exist endogenously in the cell's environment. Dose-response studies permit accurate determination of a proper quantity of polypeptide to employ. Effective quantities can be estimated from measurements of the binding affinity of a polypeptide for a target receptor, of the quantity of receptor present on target cells, of the expected dilution volume (e.g., patient weight and blood volume for in vivo embodiments), and of polypeptide clearance rates.

In another variation, the invention provides a method of modulating the signaling of one or more of PDGFR-α, PDGFR-β, VEGFR-1, VEGFR-2, and/or VEGFR-3, comprising the step or administering to a patient in need of modulation of the signaling of one or more of these receptors a composition comprising a polynucleotide of the invention, under conditions in which cells of the patient are transformed or transfected by the polynucleotide and express the polypeptide of the invention encoded thereby, wherein the expressed polypeptide modulates signaling of the one or more receptors.

As discussed below, analysis of the chimeras receptor binding properties and the sequences of VEGFR-3 ligands in relation to the sequence of VEGF-A suggests that Fragments 4 and 5 from the VEGF-C molecule are important for conferring VEGFR-3 binding affinity, and in particular the sequence of residues TNTFxxxP (SEQ ID NO: 1204) found within Fragments 4 and 5. Thus, in another variation, the invention provides molecules designed using these core residues and other substituents to modulate VEGFR-3 biological activity. For example, in one embodiment, the invention provides a molecule comprising the peptide sequence TNTF$X_n$P (SEQ ID NO: 1212), wherein $X_n$ comprises from one to seven amino acids, and wherein the molecule inhibits VEGF-C-mediated activation of VEGFR-3. The molecule may include additional residues or organic moieties. In one variation, it is contemplated that this epitope will be linked by a non-VEGF-C amino acid sequence to other epitopes involved in receptor binding, thereby creating a molecule capable of interacting with receptor loci involved in ligand binding and blocking ligand-mediated activation of the receptor. In a preferred embodiment, $X_n$ comprises three amino acids, which represents the same amino acid spacing as native VEGF-C.

In a related embodiment, the invention provides a molecule comprising the human VEGF-C peptide sequence EFGVATNTFFKPPCVSVYRCG (SEQ ID NO: 1205) or a fragment or variant thereof, wherein the molecule inhibits VEGF-C-mediated activation of VEGFR-3. In one variation, the fragment is such that the molecule comprises the amino acid sequence EFGVATNTFFKPPCVSVYRCG (SEQ ID NO: 1205). In another variation, the fragment is such that the molecule comprises the amino acid sequence TNTFFKPP (SEQ ID NO: 1206). In still another variation, the fragment or variant comprises the amino acid sequence TNTFFKPPCVxxxR (SEQ ID NO: 1207), or the amino acid sequence TNTFFKPPCVxxxRCGGCC (SEQ ID NO: 1208).

Data relating to binding properties and sequence of chimeric molecules of the invention also provides insight into the important amino acid targets for synthetic design of modulators of receptor/ligand interactions. For example, in one embodiment, the invention provides a method for identifying a modulator of VEGFR-1 binding to VEGF-A comprising the steps of (i) measuring binding between VEGFR-1 and VEGF-A in the presence and absence of a test compound under conditions that allow binding of VEGFR-1 to VEGF-A, and (ii) identifying as a modulator a test compound which alters VEGFR-1 binding to VEGF-A and which binds VEGF-A at a site defined by $Phe^{43}$, $Met^{44}$, $Tyr^{47}$, $Gln^{48}$, $Tyr^{51}$, $Gln^{105}$, and $Met^{107}$ of SEQ ID NO: 2, or which binds VEGFR-1 at VEGFR-1 residues which interface with said residues of SEQ ID NO: 2. Modulators that act as inhibitors, and are useful for ameliorating conditions characterized by undesirable or excessive ligand-mediated receptor activation, are a preferred class of modulators. Activators are another preferred class.

In a related embodiment, the invention provides a method for identifying a modulator of VEGFR-1 binding to VEGF-A comprising the steps of (i) measuring binding between VEGFR-1 and VEGF-A in the presence and absence of a test compound under conditions that allow binding of VEGFR-1 to VEGF-A, and (ii) identifying as a modulator a test compound which alters VEGFR-1 binding to VEGF-A and which binds VEGF-A at a site defined by $Lys^{42}$, $Phe^{43}$, $Met^{44}$, $Tyr^{47}$, $Gln^{48}$, $Tyr^{51}$, $Ile^{72}$, $Lys^{74}$, $Asp^{89}$, $Gly^{91}$, $Leu^{92}$, $Gln^{105}$, $Met^{107}$, $Ile^{109}$, $Phe^{111}$, $His^{112}$, $Gln^{115}$, $Ile^{117}$, $Glu^{129}$, $Arg^{131}$, and $Pro^{132}$ of SEQ ID NO: 2, or which binds VEGFR-1 at VEGFR-1 residues which interface with said residues of SEQ ID NO: 2.

Similarly, the invention provides a method for identifying a modulator of VEGFR-3 binding to VEGF-C comprising the steps of (i) measuring binding between VEGFR-3 and VEGF-C in the presence and absence of a test compound under conditions that allow binding of VEGFR-3 to VEGF-C, and (ii) identifying as a modulator a test compound which alters VEGFR-3 binding to VEGF-C and which binds VEGF-C at a site defined by $Lys^{120}$, $Ser^{121}$, $Ile^{122}$, $Trp^{126}$, $Arg^{127}$, $Gln^{130}$, $Phe^{151}$, $Lys^{153}$, $Ser^{168}$, $Gly^{170}$, $Leu^{171}$, $Tyr^{184}$, $Phe^{186}$, $Ile^{190}$, $Pro^{191}$, $Pro^{196}$, $Pro^{198}$, $Arg^{210}$, $Met^{212}$, and $Ser^{213}$ of SEQ ID NO: 22, or which binds VEGFR-3 at VEGFR-3 residues which interface with said residues of SEQ ID NO: 22. The invention also provides a method for identifying a modulator of VEGFR-3 binding to VEGF-C comprising the steps of (i) measuring binding between VEGFR-3 and VEGF-C in the presence and absence of a test compound under conditions that allow binding of VEGFR-3 to VEGF-C, and (ii) identifying as a modulator a test compound which alters VEGFR-3 binding to VEGF-C and which binds VEGF-C at a site defined by $Thr^{148}$, $Asn^{149}$, $Thr^{150}$, $Phe^{151}$, and $Pro^{155}$ of SEQ ID NO: 22, or which binds VEGFR-3 at VEGFR-3 residues which interface with said residues of SEQ ID NO: 22.

Also contemplated as aspects of the invention are compositions that comprise modulators identified by the foregoing methods, especially compositions comprising substantially purified modulators in a pharmaceutically acceptable carrier. Similarly, use of such modulators in the manufacture of a medicament for the treatment of disease states characterized by abnormal vascular endothelial growth factor receptor activity is contemplated.

In still another variation, any of the foregoing methods optionally include the additional step of administering the identified modulator to a patient in need of treatment for a disease state characterized by undesirable levels of receptor activity; or a step of contacting cells that express the receptor to modulate the level of receptor activity in the cells.

Additional embodiments, features, and variations of the invention will be apparent to those skilled in the art from the entirety of this application, including the Drawing and the Detailed Description, and all such features are intended as aspects of the invention.

Likewise, features of the invention described herein can be re-combined into additional embodiments that also are intended as aspects of the invention, irrespective of whether the combination of features is specifically mentioned above as an aspect or embodiment of the invention. Also, only such limitations which are described herein as critical to the invention should be viewed as such; variations of the invention lacking limitations which have not been described herein as critical are intended as aspects of the invention.

With respect to aspects of the invention that have been described as a set or genus, every individual member of the set or genus is intended, individually, as an aspect of the invention.

In addition to the foregoing, the invention includes, as an additional aspect, all embodiments of the invention narrower in scope in any way than the variations specifically mentioned above. Although the applicant(s) invented the full scope of the claims appended hereto, the claims appended hereto are not intended to encompass within their scope the prior art work of others. Therefore, in the event that statutory prior art within the scope of a claim is brought to the attention of the applicants by a Patent Office or other entity or individual, the applicant(s) reserve the right to exercise amendment rights under applicable patent laws to redefine the subject matter of such a claim to specifically exclude such statutory prior art or obvious variations of statutory prior art from the scope of such a claim. Variations of the invention defined by such amended claims also are intended as aspects of the invention.

BRIEF DESCRIPTION OF THE DRAWING

The patent or application file contains at least one drawing executed in color. Copies of this patent or patent application publicaiton with color drawings will be provided by the Patent and Trademark Office upon request and payment of the necessary fee.

DETAILED DESCRIPTION

Figure 1:
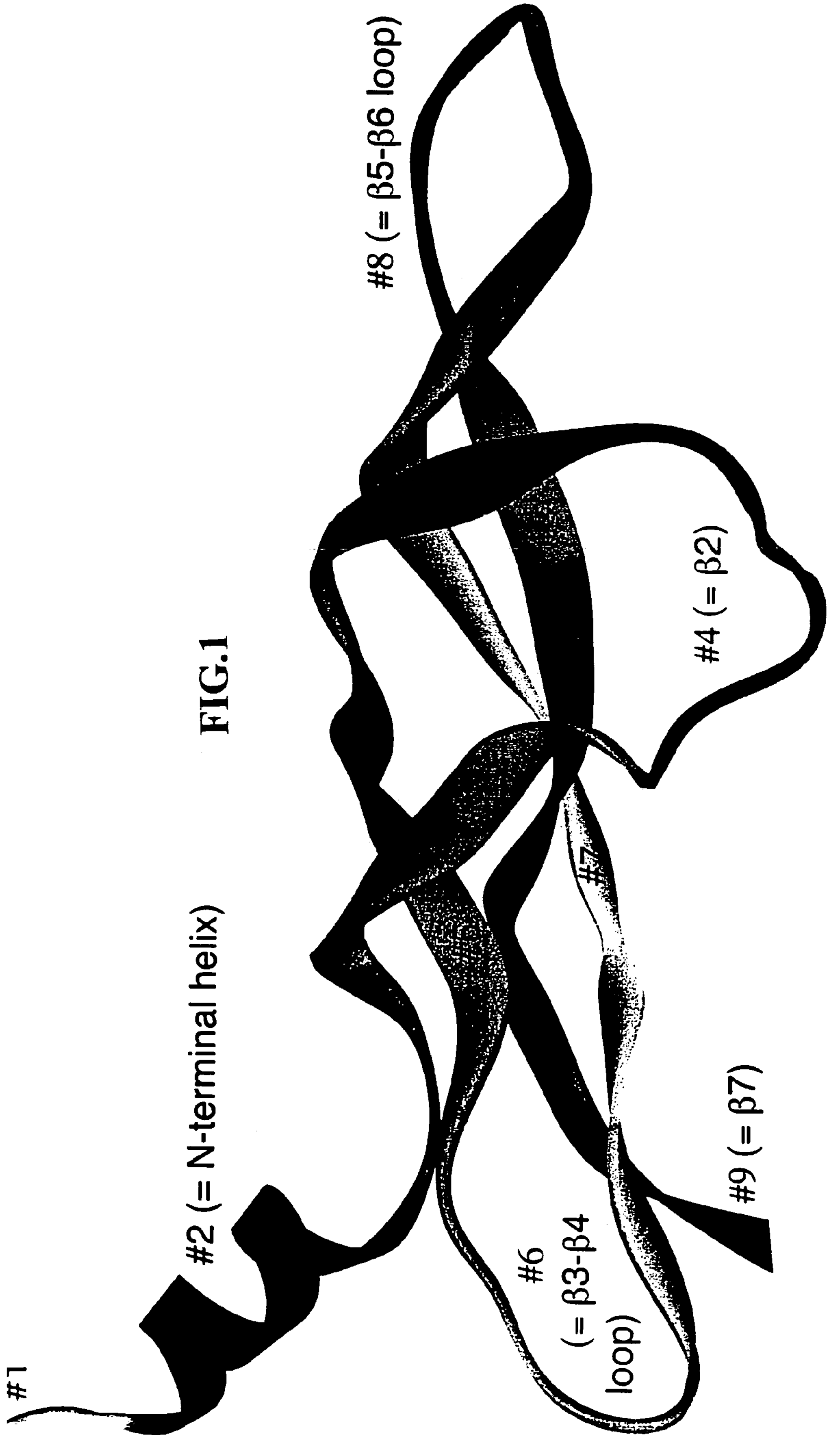
FIG. 1 depicts a perspective view of a three-dimensional model of a VEGF-A monomer, in which selected secondary structure elements are identified. A VEGF-A-encoding polynucleotide was divided into nine segments for construction of VEGF-A/VEGF-C chimeras, and labels 1-9 identify the location of the peptides encoded by each of the nine segments.

The present invention provides novel polypeptides that bind cellular receptors for vascular endothelial growth factor polypeptides; polynucleotides encoding such polypeptides; compositions comprising the polypeptides and polynucleotides; and methods and uses involving the foregoing. These materials and methods are described in detail in the preceding Summary of Invention section, which is hereby incorporated into the Detailed Description in its entirety. Some polypeptides of the invention exhibit unique receptor binding profiles compared to known, naturally occurring vascular endothelial growth factors.

Methods of Making Peptides

The peptides of the present invention may be synthesized using a variety of methods, including those described in the summary of invention and the examples. The peptides of the present invention can be synthesized in solution or on a solid support in accordance with conventional techniques. Various automatic synthesizers are commercially available and can be used in accordance with known protocols. See, for example, Stewart and Young, Solid Phase Peptide Synthesis, 2d. ed., Pierce Chemical Co., (1984);Tam et al., *J. Am. Chem. Soc.,* 105:6442, (1983); Merrifield, *Science,* 232: 341-347, (1986); and Barany and Merrifield, *The Peptides*, Gross and Meienhofer, eds, Academic Press, New York, 1-284; Barany et al., *Int. J. Peptide Protein Res.,* 30, 705-739 (1987); and U.S. Pat. No. 5,424,398), each incorporated herein by reference.

Solid phase peptide synthesis methods use a copoly (styrene-divinylbenzene) containing 0.1-1.0 mMol amines/g polymer. These methods for peptide synthesis use butyloxycarbonyl (t-BOC) or 9-fluorenylmethyloxy-carbonyl (FMOC) protection of alpha-amino groups. Both methods involve stepwise syntheses whereby a single amino acid is added at each step starting from the C-terminus of the peptide (See, Coligan, et al., Current Protocols in Immunology, Wiley Interscience, 1991, Unit 9) On completion of chemical synthesis, the peptides can be deprotected to remove the t-t-BOC or FMOC amino acid blocking groups and cleaved from the polymer by treatment with acid at reduced temperature (e.g., liquid HF-10% anisole for about 0.25 to about 1 hours at 0° C.). After evaporation of the reagents, the peptides are extracted from the polymer with 1% acetic acid solution which is then lyophilized to yield the crude material. This can normally be purified by such techniques as gel filtration on Sephadex G-15 using 5% acetic acid as a solvent. Lyophilization of appropriate fractions of the column will yield the homogeneous peptide or peptide derivatives, which can then be characterized by such standard techniques as amino acid analysis, thin layer chromatography, high performance liquid chromatography, ultraviolet absorption spectroscopy, molar rotation, solubility, and quantitated by the solid phase Edman degradation.

Other methods, such as selecting peptides from a phage display library, are available for improving upon peptide specifically described herein. Libraries can be prepared from sets of amino acids as described herein. Phage display can be particularly effective in identifying binding peptides useful according to the invention. Briefly, one prepares a phage library (using e.g. ml 13, fd, or lambda phage), displaying inserts from 4 to about 80 amino acid residues. The inserts may represent, for example, a completely degenerate or biased array. One then can select phage-bearing inserts which bind to the target VEGF receptor(s). This process can be repeated through several cycles of reselection of phage that bind to the target receptor(s). Repeated rounds lead to enrichment of phage bearing particular sequences. DNA sequence analysis can be conducted to identify the sequences of the expressed polypeptides. The minimal linear portion of the sequence that binds to the target receptor(s) can be determined. One can repeat the procedure using a biased library containing inserts containing part or all of the minimal linear portion plus one or more additional degenerate residues upstream or downstream thereof. These techniques may identify peptides of the invention with still greater receptor binding affinity than peptides already identified herein. Screening resultant peptide against multiple receptors will identify peptides with multiple receptor binding affinities. Yeast two-hybrid screening methods also may be used to identify polypeptides that bind to the target receptor(s).

Alternatively, a variety of expression vector/host systems may be utilized to contain and express the chimeric peptides of the present invention. These include but are not limited to microorganisms such as bacteria transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells that are useful in recombinant protein productions include but are not limited to VERO cells, HeLa cells, Chinese hamster ovary (CHO) cell lines, COS cells (such as COS-7), W138, BHK, HepG2, 3T3, RIN, MDCK, A549, PC12, K562 and 293 cells. Exemplary protocols for the recombinant expression of the protein are described herein below.

For example, the chimeric peptide may be recombinantly expressed in yeast using a commercially available expression system, e.g., the Pichia Expression System (Invitrogen, San Diego, Calif.), following the manufacturer's instructions. This system also relies on the pre-pro-alpha sequence to direct secretion, but transcription of the insert is driven by the alcohol oxidase (AOX1) promoter upon induction by methanol.

The secreted peptide is purified from the yeast growth medium by, e.g., the methods used to purify the chimeric peptide from bacterial and mammalian cell supernatants.

Alternatively, the cDNA encoding the peptide may be cloned into the baculovirus expression vector pVL1393 (PharMingen, San Diego, Calif.). This vector is then used according to the manufacturer's directions (PharMingen) to infect *Spodoptera frugiperda* cells in sF9 protein-free media and to produce recombinant protein. The protein is purified and concentrated from the media using a heparin-Sepharose column (Pharmacia, Piscataway, N.J.) and sequential molecular sizing columns (Amicon, Beverly, Mass.), and resuspended in PBS. SDS-PAGE analysis shows a single band and confirms the size of the protein, and Edman sequencing on a Porton 2090 Peptide Sequencer confirms its N-terminal sequence.

Alternatively, the peptide may be expressed in an insect system. Insect systems for protein expression are well known to those of skill in the art. In one such system, Autographa californica nuclear polyhedrosis virus (AcNPV) is used as a vector to express foreign genes in *Spodoptera frugiperda* cells or in *Trichoplusia* larvae. The peptide coding sequence is cloned into a nonessential region of the virus, such as the polyhedrin gene, and placed under control of the polyhedrin promoter. Successful insertion of the peptide will render the polyhedrin gene inactive and produce recombinant virus lacking coat protein coat. The recombinant viruses are then used to infect *S. frugiperda* cells or *Trichoplusia* larvae in which peptide is expressed (Smith et al., *J Virol* 46: 584, 1983; Engelhard E K et al., *Proc Nat Acad Sci* 91: 3224-7, 1994).

In another example, the DNA sequence encoding the peptide is amplified by PCR and cloned into an appropriate vector for example, pGEX-3X (Pharmacia, Piscataway, N.J.). The pGEX vector is designed to produce a fusion protein comprising glutathione-S-transferase (GST), encoded by the vector, and a protein encoded by a DNA fragment inserted into the vector's cloning site. The primers for the PCR may be generated to include for example, an appropriate cleavage site.

Where the fusion partner was used solely to facilitate expression or is otherwise not desirable as an attachment to the peptide of interest, the recombinant fusion protein may then be cleaved from the GST portion of the fusion protein. The pGEX-3X/chimeric peptide construct is transformed into *E. Coli* XL-1 Blue cells (Stratagene, La Jolla Calif.), and individual transformants were isolated and grown. Plasmid DNA from individual transformants is purified and partially sequenced using an automated sequencer to confirm the presence of the desired chimeric peptide encoding nucleic acid insert in the proper orientation.

Particularly preferred peptide compositions of the present invention are those which are conjugated to any anti-tumor peptide such as a tumor necrosis factor (TNF). In a particularly preferred method, the TNF-peptides chimeras are generated as recombinant fusions with peptide-encoding sequences fused in frame to TNF (Novagen) encoding sequences. Peptide-TNF cDNA is cloned into pET-11b vector (Novagen) and the expression of TNF-peptides in BL21 *E. coli* is induced according to the pET11b manufacturer's instruction. Soluble TNF-peptides are purified from bacterial lysates by ammonium sulfate preparation, hydrophobic interaction chromatography on Phenyl-Sepharose 6 Fast Flow, ion exchange chromatography on DEAE-Sepharose Fast Flow and gel filtration chromatography on Sephacryl-S-300 HR.

It is contemplated that recombinant protein production also may be used to produce the chimeric peptide compositions. For example, induction of the GST/chimeric peptide is achieved by growing the transformed XL-1 Blue culture at 37° C. in LB medium (supplemented with carbenicillin) to an optical density at wavelength 600 nm of 0.4, followed by further incubation for 4 hours in the presence of 0.5 mM Isopropyl β-D-Thiogalactopyranoside (Sigma Chemical Co., St. Louis Mo.).

The fusion protein, expected to be produced as an insoluble inclusion body in the bacteria, may be purified as follows. Cells are harvested by centrifugation; washed in 0.15 M NaCl, 10 mM Tris, pH 8, 1 mM EDTA; and treated with 0.1 mg/ml lysozyme (Sigma Chemical Co.) for 15 minutes at room temperature. The lysate is cleared by sonication, and cell debris is pelleted by centrifugation for 10 minutes at 12,000×g. The fusion protein-containing pellet is resuspended in 50 mM Tris, pH 8, and 10 mM EDTA, layered over 50% glycerol, and centrifuged for 30 min. at 6000×g. The pellet is resuspended in standard phosphate buffered saline solution (PBS) free of $Mg^{++}$ and $Ca^{++}$. The fusion protein is further purified by fractionating the resuspended pellet in a denaturing SDS polyacrylamide gel (Sambrook et al., supra). The gel is soaked in 0.4 M KCl to visualize the protein, which is excised and electroeluted in gel-running buffer lacking SDS. If the GST/chimeric peptide fusion protein is produced in bacteria as a soluble protein, it may be purified using the GST Purification Module (Pharmacia Biotech).

The fusion protein may be subjected to digestion to cleave the GST from the chimeric peptide of the invention. The digestion reaction (20-40 μg fusion protein, 20-30 units human thrombin (4000 U/mg (Sigma) in 0.5 ml PBS) is incubated 16-48 hrs. at room temperature and loaded on a denaturing SDS-PAGE gel to fractionate the reaction products. The gel is soaked in 0.4 M KCl to visualize the protein bands. The identity of the protein band corresponding to the expected molecular weight of chimeric peptide may be confirmed by amino acid sequence analysis using an automated sequencer (Applied Biosystems Model 473A, Foster City, Calif.). Alternatively, the identity may be confirmed by performing HPLC and/or mass spectometry of the peptides.

Alternatively, the DNA sequence encoding the chimeric peptide may be cloned into a plasmid containing a desired promoter and, optionally, a leader sequence (see, e.g., Better et al., *Science,* 240:1041-43, 1988). The sequence of this construct may be confirmed by automated sequencing. The plasmid is then transformed into *E. coli* strain MC1061 using standard procedures employing $CaCl_2$ incubation and heat shock treatment of the bacteria (Sambrook et al., supra). The transformed bacteria are grown in LB medium supplemented with carbenicillin, and production of the expressed protein is induced by growth in a suitable medium. If present, the leader sequence will effect secretion of the chimeric peptide and be cleaved during secretion.

The secreted recombinant protein is purified from the bacterial culture media by the method described herein below.

Mammalian host systems for the expression of the recombinant protein also are well known to those of skill in the art. Host cell strains may be chosen for a particular ability to process the expressed protein or produce certain post-translation modifications that will be useful in providing protein activity. Such modifications of the polypeptide include, but are not limited to, acetylation, carboxylation, glycosylation, phosphorylation, lipidation and acylation. Different host cells such as CHO, HeLa, MDCK, 293, W138, and the like have specific cellular machinery and characteristic mechanisms for such post-translational activities and may be chosen to ensure the correct modification and processing of the introduced, foreign protein.

It is preferable that the transformed cells are used for long-term, high-yield protein production and as such stable expression is desirable. Once such cells are transformed with vectors that contain selectable markers along with the desired expression cassette, the cells may be allowed to grow for 1-2 days in an enriched media before they are switched to selective media. The selectable marker is designed to confer resistance to selection and its presence allows growth and recovery of cells that successfully express the introduced sequences. Resistant clumps of stably transformed cells can be proliferated using tissue culture techniques appropriate to the cell.

A number of selection systems may be used to recover the cells that have been transformed for recombinant protein production. Such selection systems include, but are not limited to, HSV thymidine kinase, hypoxanthine-guanine phosphoribosyltransferase and adenine phosphoribosyltransferase genes, in tk-, hgprt- or aprt-cells, respectively. Also, anti-metabolite resistance can be used as the basis of selection for dhfr, that confers resistance to methotrexate; gpt, that confers resistance to mycophenolic acid; neo, that confers resistance to the aminoglycoside G418; also that confers resistance to chlorsulfuron; and hygro, that confers resistance to hygromycin. Additional selectable genes that may be useful include trpB, which allows cells to utilize indole in place of tryptophan, or hisD, which allows cells to utilize histinol in place of histidine. Markers that give a visual indication for identification of transformants include anthocyanins, beta-glucuronidase and its substrate, GUS, and luciferase and its substrate, luciferin.

For certain applications, it may be desirable to produce peptides or polypeptides of the present invention which are resistant to proteolytic digestion. Such peptides may include non-hydrolyzable peptide bonds, and peptides having end modifications such as an amide (e.g., $CONH_2$) at the C-terminus or a acetyl group at the N-terminus. It is contemplated that the peptides of the invention are modified such that their in vivo half life is increased, their physical stability is increased, rate of in vivo release and rate of in vivo clearance also may be affected.

To prepare non-hydrolyzable peptides, one may select peptides from a library non-hydrolyzable peptides, or introduce modifications to select peptides, such as one or more D-amino acids or one or more non-hydrolyzable peptide bonds linking amino acids. For example, one can select peptides having a desired receptor binding profile and then modify such peptides as necessary to reduce the potential for hydrolysis by proteases. For example, to determine the susceptibility to proteolytic cleavage, peptides may be labeled and incubated with cell extracts or purified proteases and then isolated to determine which peptide bonds are susceptible to proteolysis, e.g., by sequencing peptides and proteolytic fragments. Alternatively, potentially susceptible peptide bonds can be identified by comparing the amino acid sequence of the peptides of the present invention with the known cleavage site specificity of a panel of proteases. Based on the results of such assays, individual peptide bonds which are susceptible to proteolysis can be replaced with non-hydrolyzable peptide bonds by in vitro synthesis of the peptide.

Many non-hydrolyzable peptide bonds are known in the art, along with procedures for synthesis of peptides containing such bonds. Non-hydrolyzable bonds include $-[CH_2NH]-$ reduced amide peptide bonds, $-[COCH_2]-$ ketomethylene peptide bonds, $-[CH(CN)NH]-$ (cyanomethylene)amino peptide bonds, $-[CH_2CH(OH)]-$ hydroxyethylene peptide bonds, $-[CH_2O]-$ peptide bonds, and $-[CH_2S]-$ thiomethylene peptide bonds (see e.g., U.S. Pat. No. 6,172,043).

Peptides useful in the invention can be linear, or maybe circular or cyclized by natural or synthetic means. For example, disulfide bonds between cysteine residues may cyclize a peptide sequence. Bifunctional reagents can be used to provide a linkage between two or more amino acids of a peptide. Other methods for cyclization of peptides, such as those described by Anwer et al. (Int. J Pep. Protein Res. 36:392-399, 1990) and Rivera-Baeza et al. (Neuropeptides 30:327-333, 1996) are also known in the art.

Furthermore, nonpeptide analogs of peptides which provide a stabilized structure or lessened biodegradation, are also contemplated. Peptide mimetic analogs can be prepared based on a selected peptide by replacement of one or more residues by nonpeptide moieties. Preferably, the nonpeptide moieties permit the peptide to retain its natural confirmation, or stabilize a preferred, e.g., bioactive, confirmation. One example of methods for preparation of nonpeptide mimetic analogs from peptides is described in Nachman et al., *Regul. Pept.* 57:359-370 (1995). Peptide as used herein embraces all of the foregoing.

The polypeptides of the invention include polypeptides that are modified, for instance, by glycosylation, amidation, carboxylation, or phosphorylation, or by the creation of acid addition salts, amides, esters, in particular C-terminal esters, and N-acyl derivatives.

Also, as described above, the invention embraces polypeptides modified by forming covalent or noncovalent complexes with other moieties. Covalently-bound complexes can be prepared by linking the chemical moieties to functional groups on the side chains of amino acids comprising the peptides, or at the N- or C-terminus.

In particular, it is anticipated that the aforementioned peptides can be conjugated to a reporter group, including, but not limited to a radiolabel, a fluorescent label, an enzyme (e.g., that catalyzes a colorimetric or fluorometric reaction), a substrate, a solid matrix, or a carrier (e.g., biotin or avidin). The invention accordingly provides a molecule comprising a chimeric polypeptide comprising a plurality of peptide subunits derived from two or more vascular endothelial growth factor polypeptides, wherein the chimeric polypepitde preferably further comprises a reporter group selected from the group consisting of a radiolabel, a fluorescent label, an enzyme, a substrate, a solid matrix, and a carrier. The use of such labels is well known and is described in, e.g., U.S. Pat. No. 3,817,837; U.S. Pat. No. 3,850,752; U.S. Pat. No. 3,996,345 and U.S. Pat. No. 4,277,437. Other labels that will be useful include but are not limited to radioactive labels, fluorescent labels and chemiluminescent labels. U.S. Patents concerning use of such labels include for example U.S. Pat. No. 3,817,837; U.S. Pat. No. 3,850,752; U.S. Pat. No. 3,939,350 and U.S. Pat. No. 3,996,345. Any of the peptides of the present invention may comprise one, two, or more of any of these labels.

Methods of Using the Polypeptides of the Invention

The many biological activities mediated through the PDGF/VEGF receptor family (including but not limited to affecting growth and migration of vascular endothelial cells and blood vessels; promoting growth of lymphatic endothelial cells and lymphatic vessels; increasing vascular permeability; and affecting myelopoiesis) support numerous diagnostic and in vitro and in vivo clinical utilities for polypeptides of the invention that are capable of binding one of more members of the VEGF receptor family, for modulating (stimulating or inhibiting) these biological activities.

Multiple mechanisms exist through which polypeptides of the invention will act as growth factors (i.e., agonists or receptor stimulants). For example, polypeptides of the invention that form homodimers that bind and activate one or more members of the VEGF receptor family will be useful as vascular endothelial growth factors. Alternatively, polypeptides of the invention that form heterodimers with endogenous growth factor polypeptides (VEGF-A or VEGF-C or other family members) will also be effective agonists, provided that the heterodimers so formed are capable of binding and activating receptors to induce signal transduction.

Multiple mechanisms exist through which polypeptides of the invention will act as inhibitors (antagonists) of growth factors of the VEGF family. Polypeptides of the invention that bind but fail to stimulate one or more receptors will inhibit stimulation of the receptor by endogenous growth factor, thereby acting as an inhibitor of endogenous growth factor. Such failure to stimulate may be due, in whole or in part, to an inability to dimerize the receptor, perhaps due to an inability of the hybrid polypeptide of the invention to form growth factor homodimers. Polypeptides of the invention that form heterodimers with endogenous growth factor polypeptides will inhibit stimulation of VEGF receptors if the heterodimer fails to bind receptors, or if the heterodimer binds only to an individual receptor or a heterologous receptor pair in a manner that prevents receptor activation and signal transduction. Whichever the mechanism, polypeptides of the invention that form activity-destroying heterodimers with endogenous VEGF polypeptides (and that do not form active homodimers) are useful as antagonists of natural endogenous VEGF activity. Also, any polypeptide that binds a receptor can be conjugated to a cytotoxic or cytostotic agent in order to deliver such agents to target cells. The attachment of such agent is another means for inhibiting growth of cells in which VEGF polypeptides exhibit a mitogenic response. Exemplary toxins include chemotherapeutic, radionuclide, ricin A chain, cholera toxin, pertussis toxin, etc.

It also will be apparent that two or more hybrid polypeptides of the invention can be mixed, and that heterodimers so formed will be useful as modulators depending upon their receptor binding and stimulating properties. Because polypeptides of the invention are hybrids derived from naturally-occurring vascular endothelial growth factors that may have different receptor binding profiles, it is contemplated that some of the hybrids will act as activators of one or more receptors, and some will act as inhibitors of one or more receptors. Procedures described herein and other procedures known in the art can be used to determine receptor binding, receptor activation, and receptor inhibition properties of polypeptides of the invention.

The polypeptides of the invention that bind and activate one or more VEGF receptors may be useful for promoting angiogenesis and/or lymphangiogenesis, for example, to promote wound healing, to facilitate tissue transplantation, and to promote the formation of collateral vessels around arterial stenoses, and into injured tissues after infarction, to treat ischemia. On the other hand, polypeptides of the invention that behave as antagonists of endogenous VEGF proteins can be used in therapeutic applications to treat diseases such as neoplasias, retinopathy, rheumatoid arthritis, and psoriasis, in which suppression of angiogenesis is desirable.

Polypeptides of the present invention differ from natural VEGF receptor ligands in that some of them selectively bind one of the VEGF receptors and can thus be used to specifically induce signaling through one particular VEGF receptor. For example, polypeptides that solely induce VEGFR-3 signaling can be used therapeutically to target the lymphatic endothelia of individuals affected with lymphatic disorders, to improve the structure and function of the lymphatic vasculature of such individuals. Such polypeptides also can be used to target neoplasia characterized by cells expressing VEGFR-3 on their surfaces. Chemotaxis of monocytes/macrophages [Barleon et al., *Blood* 87:3336-3343 (1996)] due to VEGFs is mediated by VEGFR-1. Thus, molecules that specifically target the VEGFR-1 receptor can be used to direct therapeutic effects on this particular VEGF receptor. For example, inhibitors of VEGFR-1 may be used to prevent virally induced angiogenesis, and molecules that specifically activate VEGFR-1 can be used to enhance monocyte/macrophage migration. VEGFR-2 is essential for angiogenesis and sufficient for virally-induced angiogenesis. Thus, inhibitors of VEGFR-2 may be used for inhibiting angiogenesis, including that induced by viral VEGFs., whereas molecules that stimulate VEGFR-2 can be useful for promoting angiogenesis.

A subset of the polypeptides of the present invention can bind combinations of VEGF receptors not demonstrated for known natural VEGF ligands, or are able to bind all three known VEGF receptors VEGFR-1, R-2, and R-3. These polypeptides may be useful for therapies in which the activation or inhibition of different combinations of VEGF receptors is desired.

Polypeptides of the invention that can activate VEGFR-3 can be used to promote the endothelial functions of lymphatic vessels and tissues such as to treat loss of lymphatic vessels, occlusions of lymphatic vessels, lymphangiomas, and primary idiopathic lymphedemas, including Milroy's disease and lymphedema praecox, as well as secondary lymphedemas, including those resulting from removal of lymph nodes and vessels, radiotherapy and surgery in treatment of cancer, trauma and infection. Polynucleotides or polypeptides of the invention could be administered purely as a prophylactic treatment to prevent lymphedema in subjects at risk for developing lymphedema, or as a therapeutic treatment to subjects afflicted with lymphedema, for the purpose of ameliorating its symptoms (e.g., swelling due to the accumulation of lymph).

The polynucleotides and polypeptides of the invention that activate VEGFR-3 can also be used to promote re-growth or permeability of lymphatic vessels in patients whose axillary lymphatic vessels were removed during surgical interventions in the treatment of cancer (e.g., breast cancer). Polynucleotides and polypeptides of the invention can be used to treat vascularization in, for example, organ transplant patients. A composition containing the polypeptide(s) of the invention may be directly applied to the isolated vessel segment prior to its being grafted in vivo to minimize rejection of the transplanted material and to stimulate vascularization of the transplanted materials.

Polypeptides of the invention that activate VEGF receptor activity may be used to treat wounds, surgical incisions, sores, and other indications where healing is reasonably expected to be promoted if the process of neovascularization can be induced and/or accelerated.

As explained in greater detail above and reported in the literature, the expression of receptors for vascular endothelial growth factors have been observed in certain progenitor cells, such as hematopoietic progenitor cells, and VEGF-C has been observed to have myelopoietic activity. These observations provide an indication that polynucleotides or polypeptides according to the invention may be used to treat or prevent inflammation, infection, or immune disorders by modulating the proliferation, differentiation and maturation, or migration of immune cells or hematopoietic cells. Polynucleotides or polypeptides according to the invention may also be useful to promote or inhibit trafficking of leukocytes between tissues and lymphatic vessels and migration in and out of the thymus.

Polynucleotides and polypeptides of the invention can be used for stimulating myelopoiesis (especially growth of neutrophilic granuloctyes) or inhibiting it. Thus, the invention includes a method for modulating myelopoiesis in a mammalian subject comprising administering to a mammalian subject in need of modulation of myelopoiesis an amount of a polypeptide of the invention that is effective to modulate myelopoiesis. In one embodiment, a mammalian subject suffering from granulocytopenia is selected, and the method comprises administering to the subject an amount of a polypeptide effective to stimulate myelopoiesis. In particular, a polypeptide of the invention is administered in an amount effective to increase the neutrophil count in blood of the subject.

In a related embodiment, the invention includes a method of increasing the number of neutrophils in the blood of a mammalian subject comprising the step of expressing in a cell in a subject in need of an increased number of blood neutrophils a DNA encoding a polynucleotide of the invention that is able to activate signaling through VEGF receptors, the DNA operatively linked to a promoter or other control sequence that promotes expression of the DNA in the cell. Similarly, the invention includes a method of modulating the growth of neutrophilic granulocytes in vitro or in vivo comprising the step of contacting mammalian stem cells with a polypeptide of the invention in an amount effective to modulate the growth of mammalian endothelial cells.

The invention also includes a method for modulating the growth of CD34+ progenitor cells (especially hematopoietic progenitor cells and endothelial progenitor cells) in vitro or in vivo comprising the step of contacting mammalian CD34+ progenitor cells with a polypeptide of the invention in an amount effective to modulate the growth of mammalian endothelial cells. For in vitro methods, CD34+ progenitor cells isolated from cord blood or bone marrow are specifically contemplated. In vitro and in vivo methods of the invention for stimulating the growth of CD34+ precursor cells also include methods wherein polypeptides of the invention are employed together (simultaneously or sequentially) with other polypeptide factors for the purpose of modulating hematopoiesis/myelopoiesis or endothelial cell proliferation. Such other factors include, but are not limited to colony stimulating factors ("CSFs," e.g., granulocyte-CSF (G-CSF), macrophage-CSF (M-CSF) CSF), and granulocyte-macrophage-CSF (GM-CSF)), interleukin-3 (IL-3, also called multi-colony stimulating factor), other interleukins, stem cell factor (SCF), other polypeptide factors, and their analogs that have been described and are known in the art. See generally *The Cytokine Handbook, Second Ed.*, Angus Thomson (editor), Academic Press (1996); Callard and Gearing, *The Cytokine Facts Book*, Academic Press Inc. (1994); and Cowling and Dexter, *TIBTECH,* 10(10):349-357 (1992). The use of a polypeptide of the invention as a progenitor cell or myelopoietic cell growth factor or co-factor with one or more of the foregoing factors may potentiate previously unattainable myelopoietic effects and/or potentiate previously attainable myelopoietic effects while using less of the foregoing factors than would be necessary in the absence of a polypeptide of the invention.

Polynucleotides and polypeptides of the invention may also be used in the treatment of lung disorders to improve blood circulation in the lung and/or gaseous exchange between the lungs and the blood stream; to improve blood circulation to the heart and $O_2$ gas permeability in cases of cardiac insufficiency; to improve blood flow and gaseous exchange in chronic obstructive airway disease; and to treat conditions such as congestive heart failure, involving accumulations of fluid in, for example, the lung resulting from increases in vascular permeability, by exerting an offsetting effect on vascular permeability in order to counteract the fluid accumulation.

Polynucleotides and polypeptides of the invention could be used to treat malabsorptive syndromes in the intestinal tract as a result of its blood circulation increasing and vascular permeability increasing activities.

Polypeptides of the invention that bind but do not stimulate signaling through one or more of the VEGF receptors may be used to treat chronic inflammation caused by increased vascular permeability, retinopathy associated with diabetes, rheumatoid arthritis and psoriasis.

Polynucelotides or polypeptides according to the invention that are able to inhibit the function of one or more VEGF receptors can also be used to treat edema, peripheral arterial disease, Kaposi's sarcoma, or abnormal retinal development in premature newborns.

In another embodiment, the invention provides a method for modulating the growth of endothelial cells in a mammalian subject comprising the steps of exposing mammalian endothelial cells to a polypeptide according to the invention in an amount effective to modulate the growth of the mammalian endothelial cells. In one embodiment, the modulation of growth is affected by using a polypeptide capable of stimulating tyrosine phosphorylation of VEGF receptors in a host cell expressing the VEGF receptors. In modulating the growth of endothelial cells, the invention contemplates the modulation of endothelial cell-related disorders. In a preferred embodiment, the subject, and endothelial cells, are human. The endothelial cells may be provided in vitro or in vivo, and they may be contained in a tissue graft. An effective amount of a polypeptide is an amount necessary to achieve a reproducible change in cell growth rate (as determined by microscopic or macroscopic visualization and estimation of cell doubling time, or nucleic acid synthesis assays).

Since angiogenesis and neovascularization are essential for tumor growth, inhibition of angiogenic activity can prevent further growth and even lead to regression of solid tumors. Likewise inhibition of lymphangrogenesis may be instrumental in preventing metastases. Polynucleotides and polypeptides of the invention may be useful to treat neoplasias including sarcomas, melanomas, carcinomas, and gliomas by inhibiting tumor angiogenesis.

Thus, it is contemplated that a wide variety of cancers may be treated using the peptides of the present invention including cancers of the brain (glioblastoma, astrocytoma, oligodendroglioma, ependymomas), lung, liver, spleen, kidney, lymph node, pancreas, small intestine, blood cells, colon, stomach, breast, endometrium, prostate, testicle, ovary, skin, head and neck, esophagus, bone marrow, blood or other tissue.

In many contexts, it is not necessary that the tumor cell be killed or induced to undergo normal cell death or "apoptosis." Rather, to accomplish a meaningful treatment, all that is required is that the tumor growth be slowed to some degree or localized to a specific area and inhibited from spread to disparate sites. It may be that the tumor growth is completely blocked, however, or that some tumor regression is achieved. Clinical terminology such as "remission" and "reduction of tumor" burden also are contemplated given their normal usage. In the context of the present invention, the therapeutic effect may result from an inhibition of angiogenesis and/or an inhibition of lymphangiogenesis.

Thus, the invention includes a method of treating a mammalian organism suffering from a neoplastic disease characterized by expression of one or more VEGF receptor(s) in cells, comprising the steps of: identifying a mammalian organism suffering from a neoplastic disease state characterized by expression of VEGF receptor(s), and administering to the mammalian organism in need of such treatment a composition, the composition comprising one or more polynucleotide(s) or polypeptide(s) of the invention effective to inhibit VEGF receptor-mediated proliferation of the cells. Such treatment methodologies are particularly indicated for neoplastic disease states that are characterized by neovascularization involving vessels lined with endothelial cells that express increased levels of one or more VEGF receptors, relative to endothelial cells lining quiescent vessels; and disease states characterized by a cancer cells that express VEGF receptors. Targeting VEGFR-3 in tumor imaging and anti-tumor therapy is described in PCT/US99/23525 (WO 00/21560), published 20 Apr. 2000, incorporated herein by reference. Other VEGF receptors (e.g., VEGFR-1) also have been implicated in tumor angiogenesis or metastasis.

Evidence exists that at least VEGF-C and VEGF-D of the VEGF family of growth factors have utility for preventing stenosis or restenosis of blood vessels. See International Patent Application No. PCT/US99/24054 (WO 00/24412), "Use of VEGF-C or VEGF-D Gene or Protein to Prevent Restenosis," filed Oct. 26, 1999, incorporated herein by reference in its entirety. Polypeptides and polynucleotides of the invention also will have utility for these indications. Thus, in another aspect, the invention provides a method of treating a mammalian subject to prevent stenosis or restenosis of a blood vessel, comprising the step of administering to a mammalian subject in need of treatment to prevent stenosis or restenosis of a blood vessel a composition comprising one or more polypeptide(s) of the invention, in an amount effective to prevent stenosis or restenosis of the blood vessel. In a preferred embodiment, the administering comprises implanting an intravascular stent in the mammalian subject, where the stent is coated or impregnated with the composition. Exemplary materials for constructing a drug-coated or drug-impregnated stent are described in literature cited above and reviewed in Lincoff et al., Circulation, 90: 2070-2084 (1994). In another preferred embodiment, the composition comprises microparticles composed of biodegradable polymers such as PGLA, non-degradable polymers, or biological polymers (e.g., starch) which particles encapsulate or are impregnated by a polypeptide(s) of the invention. Such particles are delivered to the intravascular wall using, e.g., an infusion angioplasty catheter. Other techniques for achieving locally sustained drug delivery are reviewed in Wilensky et al., Trends Caridovasc. Med., 3:163-170 (1993), incorporated herein by reference.

Administration via one or more intravenous injections subsequent to the angioplasty or bypass procedure also is contemplated. Localization of the polypeptides of the invention to the site of the procedure occurs due to expression of VEGF receptors on proliferating endothelial cells. Localization is further facilitated by recombinantly expressing the polypeptides of the invention as a fusion polypeptide (e.g., fused to an apolipoprotein B-100 oligopeptide as described in Shih et al., Proc. Nat'l. Acad. Sci. USA, 87:1436-1440 (1990). Co-administration of polynucleotides and polypeptides of the invention is also contemplated.

Likewise, the invention also provides surgical devices that are used to treat circulatory disorders, such as intravascular or endovascular stents, balloon catheters, infusion-perfusion catheters, extravascular collars, elastomeric membranes, and the like, which have been improved by coating with, impregnating with, adhering to, or encapsulating within the device a composition comprising a polynucleotide or polypeptide of the invention.

Polynucleotides or polypeptides of the invention could be administered purely as a prophylactic treatment to prevent stenosis, or shortly before, and/or concurrently with, and/or shortly after a percutaneous transluminal coronary angioplasty procedure, for the purpose of preventing restenosis of the subject vessel. In another preferred embodiment, the polynucleotide or polypeptide is administered before, during, and/or shortly after a bypass procedure (e.g., a coronary bypass procedure), to prevent stenosis or restenosis in or near the transplanted (grafted) vessel, especially stenosis at the location of the graft itself. In yet another embodiment, the polynucleotide or polypeptide is administered before, during, or after a vascular transplantation in the vascular periphery that has been performed to treat peripheral ischemia or intermittent claudication. By prevention of stenosis or restenosis is meant prophylactic treatment to reduce the amount/severity of, and/or substantially eliminate, the stenosis or restenosis that frequently occurs in such surgical procedures. The polynucleotide or polypeptide is included in the composition in an amount and in a form effective to promote stimulation of VEGF receptors in a blood vessel of the mammalian subject, thereby preventing stenosis or restenosis of the blood vessel.

In a preferred embodiment, the mammalian subject is a human subject. For example, the subject is a person suffering from coronary artery disease that has been identified by a cardiologist as a candidate who could benefit from a therapeutic balloon angioplasty (with or without insertion of an intravascular stent) procedure or from a coronary bypass procedure. Practice of methods of the invention in other mammalian subjects, especially mammals that are conventionally used as models for demonstrating therapeutic efficacy in humans (e.g., primate, porcine, canine, or rabbit animals), also is contemplated.

Polypeptides according to the invention may be administered in any suitable manner using an appropriate pharmaceutically-acceptable vehicle, e.g., a pharmaceutically-acceptable diluent, adjuvant, excipient or carrier. The composition to be administered according to methods of the invention preferably comprises (in addition to the polynucleotide or vector) a pharmaceutically-acceptable carrier solution such as water, saline, phosphate-buffered saline, glucose, or other carriers conventionally used to deliver therapeutics intravascularly. Multi-gene therapy is also contemplated, in which case the composition optionally comprises both the polynucleotide of the invention/vector and another polynucleotide/vector selected to prevent restenosis. Exemplary candidate genes/vectors for co-transfection with transgenes encoding polypeptides of the invention are described in the literature cited above, including genes encoding cytotoxic factors, cytostatic factors, endothelial growth factors, and smooth muscle cell growth/migration inhibitors.

The "administering" that is performed according to the present method may be performed using any medically-accepted means for introducing a therapeutic directly or indirectly into the vasculature of a mammalian subject, including but not limited to injections (e.g., intravenous, intramuscular, subcutaneous, or catheter); oral ingestion; intranasal or topical administration; and the like. In a preferred embodiment, administration of the composition comprising a polynucleotide of the invention is performed intravascularly, such as by intravenous, intra-arterial, or intracoronary arterial injection. The therapeutic composition may be delivered to the patient at multiple sites. The multiple administrations may be rendered simultaneously or may be administered over a period of several hours. In certain cases it may be beneficial to provide a continuous flow of the therapeutic composition. Additional therapy may be administered on a period basis, for example, daily, weekly or monthly.

In general, peroral dosage forms for the therapeutic delivery of peptides is ineffective because in order for such a formulation to the efficacious, the peptide must be protected from the enzymatic environment of the gastrointestinal tract. Additionally, the peptide must be formulated such that it is readily absorbed by the epithelial cell barrier in sufficient concentrations to effect a therapeutic outcome. The peptides of the present invention may be formulated with uptake or absorption enhancers to increase their efficacy. Such enhancer include for example, salicylate, glycocholate/linoleate, glycholate, aprotinin, bacitracin, SDS caprate and the like. For an additional discussion of oral formulations of peptides for therapeutic delivery, those of skill in the art are referred to Fix (*J. Pharm. Sci.,* 85(12) 1282-1285, 1996) and Oliyai and Stella (*Ann. Rev. Pharmacol. Toxicol.,* 32:521-544, 1993).

The amounts of peptides in a given dosage will vary according to the size of the individual to whom the therapy is being administered as well as the characteristics of the disorder being treated. In exemplary treatments, it may be necessary to administer about 50 mg/day, 75 mg/day, 100 mg/day, 150 mg/day, 200 mg/day, 250 mg/day. These concentrations may be administered as a single dosage form or as multiple doses.

The polypeptides may also be employed in accordance with the present invention by expression of such polypeptide in vivo, which is often referred to as gene therapy. The present invention provides a recombinant DNA vector containing a heterologous segment encoding a polypeptide of the invention that is capable of being inserted into a microorganism or eukaryotic cell and that is capable of expressing the encoded protein.

In a highly preferred embodiment, the composition is administered locally. Thus, in the context of treating restenosis or stenosis, administration directly to the site of angioplasty or bypass is preferred. For example, the administering comprises a catheter-mediated transfer of the transgene-containing composition into a blood vessel of the mammalian subject, especially into a coronary artery of the mammalian subject. Exemplary materials and methods for local delivery are reviewed in Lincoff et al., Circulation, 90: 2070-2084 (1994); and Wilensky et al., Trends Cardiovasc. Med., 3:163-170 (1993), both incorporated herein by reference. For example, the composition is administered using infusion-perfusion balloon catheters (preferably mircroporous balloon catheters) such as those that have been described in the literature for intracoronary drug infusions. See, e.g., U.S. Pat. No. 5,713,860 (Intravascular Catheter with Infusion Array); U.S. Pat. No. 5,087,244; U.S. Pat. No. 5,653,689; and Wolinsky et al., J. Am. Coll. Cardiol., 15: 475-481 (1990) (Wolinsky Infusion Catheter); and Lambert et al., Coron. Artery Dis., 4: 469-475 (1993), all of which are incorporated herein by reference in their entirety. Use of such catheters for site-directed somatic cell gene therapy is described, e.g., in Mazur et al., Texas Heart Institute Journal, 21; 104-111 (1994), incorporated herein by reference. In an embodiment where the transgene encoding a polypeptide of the invention is administered in an adenovirus vector, the vector is preferably administered in a pharmaceutically acceptable carrier at a titer of $10^7$-$10^{13}$ viral particles, and more preferably at a titer of $10^9$-$10^{11}$ viral particles. The adenoviral vector composition preferably is infused over a period of 15 seconds to 30 minutes, more preferably 1 to 10 minutes.

For example, in patients with angina pectoris due to a single or multiple lesions in coronary arteries and for whom PTCA is prescribed on the basis of primary coronary angiogram findings, an exemplary protocol involves performing PTCA through a 7F guiding catheter according to standard clinical practice using the femoral approach. If an optimal result is not achieved with PTCA alone, then an endovascular stent also is implanted. (A nonoptimal result is defined as residual stenosis of >30% of the luminal diameter according to a visual estimate, and B or C type dissection.) Arterial gene transfer at the site of balloon dilatation is performed with a replication-deficient adenoviral vector expressing a polypeptide of the invention immediately after the angioplasty, but before stent implantation, using an infusion-perfusion balloon catheter. The size of the catheter will be selected to match the diameter of the artery as measured from the angiogram, varying, e.g., from 3.0 to 3.5F in diameter. The balloon is inflated to the optimal pressure and gene transfer is performed during a 10 minute infusion at the rate of 0.5 ml/min with virus titer of $1.15\times10^{10}$.

In another embodiment, intravascular administration with a gel-coated catheter. is contemplated, as has been described in the literature to introduce other transgenes. See, e.g., U.S. Pat. No. 5,674,192 (Catheter coated with tenaciously-adhered swellable hydrogel polymer); Riessen et al., Human Gene Therapy, 4: 749-758 (1993); and Steg et al., Circulation, 96: 468-411 (1997) and 90: 1648-1656 (1994); all incorporated herein by reference. Briefly, DNA in solution (e.g., a polynucleotide of the invention) is applied one or more times ex vivo to the surface of an inflated angioplasty catheter balloon coated with a hydrogel polymer (e.g., Slider with Hydroplus, Mansfield Boston Scientific Corp., Watertown, Mass.). The Hydroplus coating is a hydrophilic polyacrylic acid polymer that is cross-linked to the balloon to form a high molecular weight hydrogel tightly adhered to the balloon. The DNA covered hydrogel is permitted to dry before deflating the balloon. Re-inflation of the balloon intravascularly, during an angioplasty procedure, causes the transfer of the DNA to the vessel wall.

In yet another embodiment, an expandable elastic membrane or similar structure mounted to or integral with a balloon angioplasty catheter or stent is employed to deliver the transgene encoding a polypeptide of the invention. See, e.g., U.S. Pat. Nos. 5,707,385, 5,697,967, 5,700,286, 5,800,507, and 5,776,184, all incorporated by reference herein.

In another variation, the composition containing the transgene encoding a polypeptide of the invention is administered extravascularly, e.g., using a device to surround or encapsulate a portion of vessel. See, e.g., International Patent Publication WO 98/20027, incorporated herein by reference, describing a collar that is placed around the outside of an artery (e.g., during a bypass procedure) to deliver a transgene to the arterial wall via a plasmid or liposome vector.

In still another variation, endothelial cells or endothelial progenitor cells are transfected ex vivo with the transgene encoding a polypeptide of the invention, and the transfected cells as administered to the mammalian subject. Exemplary procedures for seeding a vascular graft with genetically modified endothelial cells are described in U.S. Pat. No. 5,785,965, incorporated herein by reference.

In preferred embodiments, polynucleotides of the invention further comprises additional sequences to facilitate the gene therapy. In one embodiment, a "naked" transgene encoding a polypeptide of the invention (i.e., a transgene without a viral, liposomal, or other vector to facilitate transfection) is employed for gene therapy. In this embodiment, the polynucleotide of the invention preferably comprises a suitable promoter and/or enhancer sequence (e.g., cytomegalovirus promoter/enhancer [Lehner et al., J. Clin. Microbiol., 29:2494-2502 (1991); Boshart et al., Cell, 41:521-530 (1985)]; Rous sarcoma virus promoter [Davis et al., Hum. Gene Ther., 4:151 (1993)]; Tie promoter [Korhonen et al., Blood, 86(5): 1828-1835 (1995)]; or simian virus 40 promoter) for expression in the target mammalian cells, the promoter being operatively linked upstream (i.e., 5') of the polypeptide-coding sequence. The polynucleotides of the invention also preferably further includes a suitable polyadenylation sequence (e.g., the SV40 or human growth hormone gene polyadenylation sequence) operably linked downstream (i.e., 3') of the polypeptide-coding sequence. The polynucleotides of the invention also preferably comprise a nucleotide sequence encoding a secretory signal peptide fused in-frame with the polypeptide sequence. The secretory signal peptide directs secretion of the polypeptide of the invention by the cells that express the polynucleotide, and is cleaved by the cell from the secreted polypeptide. The signal peptide sequence can be that of another secreted protein, or can be a completely synthetic signal sequence effective to direct secretion in cells of the mammalian subject.

The polynucleotide may further optionally comprise sequences whose only intended function is to facilitate large-scale production of the vector, e.g., in bacteria, such as a bacterial origin of replication and a sequence encoding a selectable marker. However, in a preferred embodiment, such extraneous sequences are at least partially cleaved off prior to administration to humans according to methods of the invention. One can manufacture and administer such polynucleotides to achieve successful gene therapy using procedures that have been described in the literature for other transgenes. See, e.g., Isner et al., Circulation, 91: 2687-2692 (1995); and Isner et al., Human Gene Therapy, 7: 989-1011 (1996); incorporated herein by reference in the entirety.

Any suitable vector may be used to introduce the transgene encoding one of the polypeptides of the invention, into the host. Exemplary vectors that have been described in the literature include replication-deficient retroviral vectors, including but not limited to lentivirus vectors [Kim et al., J. Virol., 72(1): 811-816 (1998); Kingsman & Johnson, Scrip Magazine, October, 1998, pp. 43-46.]; adeno-associated viral vectors [U.S. Pat. No. 5,474,935; U.S. Pat. No. 5,139,941; U.S. Pat. No. 5,622,856; U.S. Pat. No. 5,658,776; U.S. Pat. No. 5,773,289; U.S. Pat. No. 5,789,390; U.S. Pat. No. 5,834,441; U.S. Pat. No. 5,863,541; U.S. Pat. No. 5,851,521; U.S. Pat. No. 5,252,479; Gnatenko et al., J. Investig. Med., 45: 87-98 (1997)]; adenoviral vectors [See, e.g., U.S. Pat. No. 5,792,453; U.S. Pat. No. 5,824,544; U.S. Pat. No. 5,707,618; U.S. Pat. No. 5,693,509; U.S. Pat. No. 5,670,488; U.S. Pat. No. 5,585,362; Quantin et al., Proc. Natl. Acad. Sci. USA, 89: 2581-2584 (1992); Stratford-Perricadet et al., J. Clin. Invest., 90: 626-630 (1992); and Rosenfeld et al., Cell, 68: 143-155 (1992)]; an adenoviral-adenoassociated viral hybrid (see for example, U.S. Pat. No. 5,856,152) or a vaccinia viral or a herpesviral (see for example, U.S. Pat. No. 5,879,934; U.S. Pat. No. 5,849,571; U.S. Pat. No. 5,830,727; U.S. Pat. No. 5,661,033; U.S. Pat. No. 5,328,688; Lipofectin-mediated gene transfer (BRL); liposomal vectors [See, e.g., U.S. Pat. No. 5,631,237 (Liposomes comprising Sendai virus proteins)]; and combinations thereof. All of the foregoing documents are incorporated herein by reference in their entirety. Replication-deficient adenoviral vectors constitute a preferred embodiment.

Other non-viral delivery mechanisms contemplated include calcium phosphate precipitation (Graham and Van Der Eb, *Virology,* 52:456-467, 1973; Chen and Okayama, *Mol. Cell Biol.,* 7:2745-2752, 1987; Rippe et al., *Mol. Cell Biol.,* 10:689-695, 1990) DEAE-dextran (Gopal, *Mol. Cell Biol.,* 5:1188-1190, 1985), electroporation (Tur-Kaspa et al., *Mol. Cell Biol.,* 6:716-718, 1986; Potter et al., *Proc. Nat. Acad. Sci. USA,* 81:7161-7165, 1984), direct microinjection (Harland and Weintraub, *J. Cell Biol.,* 101: 1094-1099, 1985.), DNA-loaded liposomes (Nicolau and Sene, *Biochim. Biophys. Acta,* 721:185-190, 1982; Fraley et al., *Proc. Natl. Acad. Sci. USA,* 76:3348-3352, 1979; Felgner, *Sci Am.* 276(6):102-6, 1997; Felgner, *Hum Gene Ther.* 7(15):1791-3, 1996), cell sonication (Fechheimer et al., *Proc. Natl. Acad. Sci. USA,* 84:8463-8467, 1987), gene bombardment using high velocity microprojectiles (Yang et al., *Proc. Natl. Acad. Sci USA,* 87:9568-9572, 1990), and receptor-mediated transfection (Wu and Wu, *J. Biol. Chem.,* 262:4429-4432, 1987; Wu and Wu, *Biochemistry,* 27:887-892, 1988; Wu and Wu, *Adv. Drug Delivery Rev.,* 12:159-167, 1993).

In a particular embodiment of the invention, the expression construct (or indeed the peptides discussed above) may be entrapped in a liposome. Liposomes are vesicular structures characterized by a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh and Bachhawat, *In: Liver diseases, targeted diagnosis and therapy using specific receptors and ligands*, Wu G, Wu C ed., New York: Marcel Dekker, pp. 87-104, 1991). The addition of DNA to cationic liposomes causes a topological transition from liposomes to optically birefringent liquid-crystalline condensed globules (Radler et al., *Science,* 275(5301):810-4, 1997). These DNA-lipid complexes are potential non-viral vectors for use in gene therapy and delivery.

Liposome-mediated nucleic acid delivery and expression of foreign DNA in vitro has been very successful. Also contemplated in the present invention are various commercial approaches involving "lipofection" technology. In certain embodiments of the invention, the liposome may be complexed with a hemagglutinating virus (HVJ). This has been shown to facilitate fusion with the cell membrane and promote cell entry of liposome-encapsulated DNA (Kaneda et al., *Science,* 243:375-378, 1989). In other embodiments, the liposome may be complexed or employed in conjunction with nuclear nonhistone chromosomal proteins (HMG-1) (Kato et al., *J. Biol. Chem.,* 266:3361-3364, 1991). In yet further embodiments, the liposome maybe complexed or employed in conjunction with both HVJ and HMG-1. In that such expression constructs have been successfully employed in transfer and expression of nucleic acid in vitro and in vivo, then they are applicable for the present invention.

Other vector delivery systems that can be employed to deliver a nucleic acid encoding a therapeutic gene into cells include receptor-mediated delivery vehicles. These take advantage of the selective uptake of macromolecules by receptor-mediated endocytosis in almost all eukaryotic cells. Because of the cell type-specific distribution of various receptors, the delivery can be highly specific (Wu and Wu, 1993, supra).

Receptor-mediated gene targeting vehicles generally consist of two components: a cell receptor-specific ligand and a DNA-binding agent. Several ligands have been used for receptor-mediated gene transfer. The most extensively characterized ligands are asialoorosomucoid (ASOR) (Wu and Wu, 1987, supra) and transferrin (Wagner et al., *Proc. Nat'l. Acad Sci. USA,* 87(9):3410-3414, 1990). Recently, a synthetic neoglycoprotein, which recognizes the same receptor as ASOR, has been used as a gene delivery vehicle (Ferkol et al., *FASEB J.,* 7:1081-1091, 1993; Perales et al., *Proc. Natl. Acad. Sci., USA* 91:4086-4090, 1994) and epidermal growth factor (EGF) has also been used to deliver genes to squamous carcinoma cells (Myers, EPO 0273085).

In other embodiments, the delivery vehicle may comprise a ligand and a liposome. For example, Nicolau et al. (*Methods Enzymol.,* 149:157-176, 1987) employed lactosyl-ceramide, a galactose-terminal asialganglioside, incorporated into liposomes and observed an increase in the uptake of the insulin gene by hepatocytes. Thus, it is feasible that a nucleic acid encoding a therapeutic gene also may be specifically delivered into a particular cell type by any number of receptor-ligand systems with or without liposomes.

In another embodiment of the invention, the expression construct may simply consist of naked recombinant DNA or plasmids. Transfer of the construct may be performed by any of the methods mentioned above that physically or chemically permeabilize the cell membrane. This is applicable particularly for transfer in vitro, however, it may be applied for in vivo use as well. Dubensky et al. (*Proc. Nat. Acad. Sci. USA,* 81:7529-7533, 1984) successfully injected polyomavirus DNA in the form of $CaPO_4$ precipitates into liver and spleen of adult and newborn mice demonstrating active viral replication and acute infection. Benvenisty and Neshif (*Proc. Nat. Acad. Sci. USA,* 83:9551-9555, 1986) also demonstrated that direct intraperitoneal injection of $CaPO_4$ precipitated plasmids results in expression of the transfected genes.

Another embodiment of the invention for transferring a naked DNA expression construct into cells may involve particle bombardment. This method depends on the ability to accelerate DNA coated microprojectiles to a high velocity allowing them to pierce cell membranes and enter cells without killing them (Klein et al., *Nature,* 327:70-73, 1987). Several devices for accelerating small particles have been developed. One such device relies on a high voltage discharge to generate an electrical current, which in turn provides the motive force (Yang et al., *Proc. Natl. Acad. Sci USA,* 87:9568-9572, 1990). The microprojectiles used have consisted of biologically inert substances such as tungsten or gold beads.

In embodiments employing a viral vector, preferred polynucleotides still include a suitable promoter and polyadenylation sequence as described above. Moreover, it will be readily apparent that, in these embodiments, the polynucleotide further includes vector polynucleotide sequences (e.g., adenoviral polynucleotide sequences) operably connected to the sequence encoding a polypeptide of the invention.

Thus, in one embodiment the composition to be administered comprises a vector, wherein the vector comprises a polynucleotide of the invention. In a preferred embodiment, the vector is an adenovirus vector. In a highly preferred embodiment, the adenovirus vector is replication-deficient, i.e., it cannot replicate in the mammalian subject due to deletion of essential viral-replication sequences from the adenoviral genome. For example, the inventors contemplate a method wherein the vector comprises a replication-deficient adenovirus, the adenovirus comprising the polynucleotide of the invention operably connected to a promoter and flanked on either end by adenoviral polynucleotide sequences.

Similarly, the invention includes kits which comprise compounds or compositions of the invention packaged in a manner which facilitates their use to practice methods of the invention. In a simplest embodiment, such a kit includes a compound or composition described herein as useful for practice of the invention (e.g., polynucleotides or polypeptides of the invention), packaged in a container such as a sealed bottle or vessel, with a label affixed to the container or included in the package that describes use of the compound or composition to practice the method of the invention. Preferably, the compound or composition is packaged in a unit dosage form. In another embodiment, a kit of the invention includes a composition of both a polynucleotide or polypeptide packaged together with a physical device useful for implementing methods of the invention, such as a stent, a catheter, an extravascular collar, a polymer film, or the like. In another embodiment, a kit of the invention includes compositions of both a polynucleotide or polypeptide of the invention packaged together with a hydrogel polymer, or microparticle polymers, or other carriers described herein as useful for delivery of the polynucleotides or polypeptides to the patient.

The polypeptides of the present invention are useful in diagnostic or prognostic assays for detecting VEGF receptor protein expression. Polypeptides of the invention that bind to one or more VEGF receptors may be used for detecting and measuring the presence of specific receptor proteins in samples for purposes such as e.g., medical imaging, detection, screening, or targeted therapy. Detectable labels such as radioactive or non-radioactive labels, including enzyme labels or labels of the biotin/avidin system, may be used to tag the polypeptide of the invention. The polypeptide may also be covalently or non-covalently coupled to a suitable supermagnetic, paramagnetic, electron dense, ecogenic or radioactive agent for imaging.

The present invention also relates to a diagnostic assay for detecting altered levels of VEGF receptor proteins in various tissues since over-expression of the proteins compared to normal control tissue samples may detect the presence of a disease or susceptibility to a disease, for example, abnormal cell growth or differentiation. Polypeptides of the invention can be used to quantify future metastatic risk by assaying biopsy material for the presence of active receptors or ligands in a binding assay or kit using detectably-labeled polypeptides of the invention.

A related aspect of the invention is a method for the detection of specific cells, e.g., endothelial cells. These cells may be found in vivo, or in ex vivo biological tissue samples. The method of detection comprises the steps of contacting a biological tissue comprising, e.g., endothelial cells, with a hybrid polypeptide according to the invention which is capable of binding to VEGFR(s), under conditions wherein the hybrid polypeptide binds to the cells, optionally washing the biological tissue, and detecting the hybrid polypeptide bound to the cells in the biological tissue, thereby detecting the cells. It will be apparent that certain polypeptides of the invention are useful for detecting and/or imaging cells that express more than one VEGFR, whereas other polypeptides are useful for imaging cells which specifically express a particular VEGFR.

The invention also is directed to a method for imaging vertebrate tissue suspected of containing cells that express a specific VEGFR comprising the steps of: (a) contacting vertebrate tissue with a composition comprising polypeptide(s) of the invention that specifically bind the particular VEGFR; and (b) imaging the tissue by detecting the VEGFR-binding polypeptide bound to the tissue. Preferably, the tissue is human tissue, and the method further comprises the step of washing the tissue, after the contacting step and before the imaging step, under conditions that remove from the tissue polypeptides that are not bound to the VEGFR in the tissue.

In a related variation, the invention provides a method for imaging tumors in tissue from a vertebrate organism, comprising the steps of: (a) contacting vertebrate tissue suspected of containing a tumor with a composition comprising a VEGFR binding compound; (b) detecting the VEGFR binding compound bound to cells in said tissue; and (c) imaging solid tumors by identifying blood vessel endothelial cells bound by the VEGFR binding compound, wherein blood vessels expressing VEGFR are correlated with the presence and location of a tumor in the tissue.

The present invention also is directed to the use of hybrid polypeptides of the invention that bind VEGF receptors as specific markers for particular tissues and cell types. For example, those polypeptides of the invention that specifically bind VEGFR-3 can serve as markers for lymphatic endothelial cells.

Similarly, polypeptides of the invention may be screened for an ability to modulate the growth of isolated cells or cell lines. For example, certain neoplastic disease states are characterized by the appearance of VEGF receptors on cell surfaces [Valtola et a., *Am J Path* 154:1381-90 (1999)]. Polypeptides of the invention may be screened to determine the ability of the polypeptide to modulate the growth of the neoplastic cells. Other disease states are likely characterized by mutations in VEGF receptors [Ferrell et al., *Hum Mol Genetics* 7:2073-78 (1998)]. Polypeptides of the invention that modulate the activity of the mutant forms of the VEGF receptor in a manner different than naturally-occurring vascular endothelial growth factors will be useful at modulating the symptoms and severity of the such disease states.

In vivo imaging or tissue biopsy may reveal that certain neoplastic cells are expressing a particular combination of receptors, thereby providing an indication for polypeptides of the invention that bind the expressed set of receptors and inhibit ligand mediated growth.

The use of such diagnostic imaging is particularly suitable in obtaining an image of, for example, a tumor mass or the neovascularizarion near a tumor mass. It is contemplated that the peptides of the present invention may be employed for imaging in a manner analogous to the antibody-based methods disclosed in U.S. Pat. No. 6,107,046, incorporated herein by reference.

Many appropriate imaging agents are known in the art, as are methods of attaching the labeling agents to the peptides of the invention (see, e.g., U.S. Pat. No. 4,965,392, U.S. Pat. No. 4,472,509, U.S. Pat. No. 5,021,236 and U.S. Pat. No. 5,037,630, incorporated herein by reference). The labeled peptides are administered to a subject in a pharmaceutically acceptable carrier, and allowed to accumulate at a target site having the VEGFR-3 receptor. This peptide imaging agent then serves as a contrast reagent for X-ray, magnetic resonance, sonographic or scintigraphic imaging of the target site. The peptides of the present invention are a convenient and important addition to the available arsenal of medical imaging tools for the diagnostic investigation of cancer and other VEGFR-3 related disorders.

Paramagnetic ions useful in the imaging agents of the present invention include for example chromium(III), manganese(II), iron(III), iron(II), cobalt(II), nickel(II), copper (II), neodymium(III), samarium(III), ytterbium(III), gadolinium(III), vanadium(II), terbium(III), dysprosium(III), holmium(III) and erbium(III). Ions useful for X-ray imaging include but are not limited to lantanum(III), gold(III), lead (II) and particularly bismuth(III). Radioisotopes for diagnostic applications include for example, $^{211}$astatine, $^{14}$carbon, $^{51}$chromium, $^{36}$chlorine, $^{57}$cobalt, $^{67}$copper, $^{152}$Eu, $^{67}$gallium, $^{3}$hydrogen, $^{123}$iodine, $^{125}$iodine, $^{111}$indium, $^{59}$iron, $^{32}$phosphorus, $^{186}$rhenium, $^{75}$selenium, $^{35}$sulphur, $^{99m}$technicium and $^{90}$yttrium.

The peptides of the present invention may be labeled according to techniques well known to those of skill in the art. For example, the peptides can be iodinated by contacting the peptide with sodium or potassium iodide and a chemical oxidizing agent such as sodium hypochlorite or an enzymatic oxidant such as lactoperoxidase. Peptides may be labeled with technetium-99m by ligand exchange, for example, by reducing pertechnate with stannous solution, chelating the reduced technetium onto a Sephadex column and applying the peptide to the column. These and other techniques for labeling proteins and peptides are well known to those of skill in the art.

Using Polypeptides of the Invention in Combined Therapy for Neoplastic Disorders Tumor cell resistance to DNA damaging agents represents a major problem in clinical oncology. One goal of current cancer research is to find ways to improve the efficacy of chemo- and radiotherapy. As described above, the peptides of the present invention may be administered in conjunction with chemo- or radiotherapeutic intervention, immunotherapy, or with other anti-angiogenic/anti-lymphangiogenic therapy.

To kill cells, inhibit cell growth, inhibit metastasis, inhibit angiogenesis or otherwise reverse or reduce the malignant phenotype of tumor cells via combination therapy, using the methods and compositions of the present invention, one would generally contact a "target" cell or tissue, (e.g., a tumor and/or its vasculature) with the therapeutic peptides of the present invention (either as a peptide composition or as an expression construct that will express the peptide) and at least one other agent, which optionally is conjugated to the peptide of the invention. These compositions would be provided in a combined amount effective to kill or inhibit proliferation of the cancer by killing and/or inhibiting the proliferation of the cancer cells and/or the endothelia of blood and lymphatic vessels supplying and serving the cancer cells. This process may involve contacting the cells with the peptide or expression construct and the agent(s) or factor(s) at the same time. This may be achieved by contacting the cell with a single composition or pharmacological formulation that includes both agents, or by contacting the cell with two distinct compositions or formulations, at the same time, wherein one composition includes the peptide or expression construct and the other includes the second agent.

Alternatively, the therapeutic treatment employing the peptides of the present invention may precede or follow the other agent treatment by intervals ranging from minutes to weeks. In embodiments where the other agent and expression construct are administered separately, one would generally ensure that a significant period of time did not expire between the time of each delivery, such that the agent and the peptide-based therapeutic would still be able to exert an advantageously combined effect. In such instances, it is contemplated that one would administer both modalities within about 12-24 hours of each other and, more preferably, within about 6-12 hours of each other, with a delay time of only about 12 hours being most preferred. In some situations, it may be desirable to extend the time period for treatment significantly, however, where several days (2, 3, 4, 5, 6 or 7) to several weeks (1, 2, 3, 4, 5, 6, 7 or 8) lapse between the respective administrations. Repeated treatments with one or both agents is specifically contemplated. In specific embodiments, an anti-cancer therapy may be delivered which directly attacks the cancer cells in a manner to kill, inhibit or necrotize the cancer cell, in addition a therapeutic composition based on the peptides of the present invention also is administered to the individual in amount effective to have an antiangiogenic and/or anti-lymphangiogenic effect. The peptide compositions may be administered following the other anti-cancer agent, before the other anti-cancer agent or indeed at the same time as the other anti-cancer agent, optionally conjugated to the other agent.

Agents or factors suitable for use in a combined therapy are any chemical compound or treatment method that induces DNA damage when applied to a cell. Such agents and factors include radiation and waves that induce DNA damage such as, γ-irradiation, X-rays, UV-irradiation, microwaves, electronic emissions, and the like. A variety of chemical compounds, also described as "chemotherapeutic agents," function to induce DNA damage, all of which are intended to be of use in the combined treatment methods disclosed herein. Chemotherapeutic agents contemplated to be of use, include, e.g., adriamycin, 5-fluorouracil (5FU), etoposide (VP-16), camptothecin, actinomycin-D, mitomycin C, cisplatin (CDDP) and even hydrogen peroxide. The invention also encompasses the use of a combination of one or more DNA damaging agents, whether radiation-based or actual compounds, such as the use of X-rays with cisplatin or the use of cisplatin with etoposide.

In treating cancer according to the invention, one would contact the tumor cells and/or the endothelia of the tumor vessels with an agent in addition to the therapeutic agent comprising one or more peptide of the present invention. This may be achieved by irradiating the localized tumor site with radiation such as X-rays, UV-light, gamma-rays or even microwaves. Alternatively, the tumor cells may be contacted with the agent by administering to the subject a therapeutically effective amount of a pharmaceutical composition comprising a compound such as, adriamycin, 5-fluorouracil, etoposide, camptothecin, actinomycin-D, mitomycin C, or cisplatin. Kinase inhibitors also contemplated to be useful in combination therapies with the peptides of the present invention. The agent may be prepared and used as a combined therapeutic composition, or kit, by combining it with a chimeric peptide of the invention, as described above.

Agents that directly cross-link nucleic acids, specifically DNA, are envisaged to facilitate DNA damage leading to a synergistic, antineoplastic combination with chimeric peptide-based therapy. Agents such as cisplatin, and other DNA alkylating agents may be used. Cisplatin has been widely used to treat cancer, with efficacious doses used in clinical applications of 20 $mg/m^2$ for 5 days every three weeks for a total of three courses. Cisplatin is not absorbed orally and must therefore be delivered via injection intravenously, subcutaneously, intratumorally or intraperitoneally.

Agents that damage DNA also include compounds that interfere with DNA replication, mitosis and chromosomal segregation. Such chemotherapeutic compounds include adriamycin, also known as doxorubicin, etoposide, verapamil, podophyllotoxin, and the like. Widely used in a clinical setting for the treatment of neoplasms, these compounds are administered through bolus injections intravenously at doses ranging from 25-75 $mg/m^2$ at 21 day intervals for adriamycin, to 35-50 $mg/m^2$ for etoposide intravenously or double the intravenous dose orally.

Agents that disrupt the synthesis and fidelity of nucleic acid precursors and subunits also lead to DNA damage. As such a number of nucleic acid precursors have been developed. Particularly useful are agents that have undergone extensive testing and are readily available. As such, agents such as 5-fluorouracil (5-FU), are preferentially used by neoplastic tissue, making this agent particularly useful for targeting to neoplastic cells. Although quite toxic, 5-FU, is applicable in a wide range of carriers, including topical, however intravenous administration with doses ranging from 3 to 15 mg/kg/day being commonly used.

By way of example the following is a list of chemotherapeutic agents and the cancers which have been shown to be managed by administration of such agents. Combinations of these chemotherapeutics with the peptides of the present invention may prove to be useful in amelioration of various neoplastic disorders. Examples of these compounds include adriamycin (also known as doxorubicin), VP-16 (also known as etoposide), and the like, daunorubicin (intercalates into DNA, blocks DNA-directed RNA polymerase and inhibits DNA synthesis); mitomycin (also known as mutamycin and/or mitomycin-C) is an antibiotic isolated from the broth of Streptomyces caespitosus which has been shown to have antitumor activity; Actinomycin D also may be a useful drug to employ in combination with the peptides of the present invention because tumors which fail to respond to systemic treatment sometimes respond to local perfusion with dactinomycin which also is known to potentiate radiotherapy. It also is used in combination with primary surgery, radiotherapy, and other drugs, particularly vincristine and cyclophosphamide and has been found to be effective against Ewing's tumor, Kaposi's sarcoma, and soft-tissue sarcomas, choriocarcinoma, metastatic testicular carcinomas, Hodgkin's disease and non-Hodgkin's lymphomas.

Bleomycin is a mixture of cytotoxic glycopeptide antibiotics isolated from a strain of *Streptomyces verticillus*, is effective in the management of the following neoplasms either as a single agent or in proven combinations with other approved chemotherapeutic agents in squamous cell carcinoma such as head and neck (including mouth, tongue, tonsil, nasopharynx, oropharynx, sinus, palate, lip, buccal mucosa, gingiva, epiglottis, larynx), skin, penis, cervix, and vulva. It has also been used in the treatment of lymphomas and testicular carcinoma.

Cisplatin has been widely used to treat cancers such as metastatic testicular or ovarian carcinoma, advanced bladder cancer, head or neck cancer, cervical cancer, lung cancer or other tumors and may be a useful combination with the peptides of the present invention. VP16 (etoposide) and is used primarily for treatment of testicular tumors, in combination with bleomycin and cisplatin, and in combination with cisplatin for small-cell carcinoma of the lung. It is also active against non-Hodgkin's lymphomas, acute nonlymphocytic leukemia, carcinoma of the breast, and Kaposi's sarcoma associated with acquired immunodeficiency syndrome (AIDS). Tumor Necrosis Factor [TNF; Cachectin] glycoprotein that kills some kinds of cancer cells, activates cytokine production, activates macrophages and endothelial cells, promotes the production of collagen and collagenases, is an inflammatory mediator and also a mediator of septic shock, and promotes catabolism, fever and sleep. TNF can be quite toxic when used alone in effective doses, so that the optimal regimens probably will use it in lower doses in combination with other drugs. Its immunosuppressive actions are potentiated by γ-interferon, so that the combination potentially is dangerous. A hybrid of TNF and interferon-α also has been found to possess anti-cancer activity.

Taxol an antimitotic agent original isolated from the bark of the ash tree, *Taxus brevifolia*, and its derivative paclitaxol have proven useful against breats cancer and may be used in the combination therapies of the present invention. Beneficial responses to vincristine have been reported in patients with a variety of other neoplasms, particularly Wilms' tumor, neuroblastoma, brain tumors, rhabdomyosarcoma, and carcinomas of the breast, bladder, and the male and female reproductive systems. Vinblastine also is indicated as a useful therapeutic in the same cancers as vincristine. The most frequent clinical use of vinblastine is with bleomycin and cisplatin in the curative therapy of metastatic testicular tumors. It is also active in Kaposi's sarcoma, neuroblastoma, and Letterer-Siwe disease (histiocytosis X), as well as in carcinoma of the breast and choriocarcinoma in women.

Melphalan also known as alkeran, L-phenylalanine mustard, phenylalanine mustard, L-PAM, or L-sarcolysin, is a phenylalanine derivative of nitrogen mustard. Melphalan is a bifunctional alkylating agent which is active against selective human neoplastic diseases. Melphalan is the active L-isomer of the D-isomer, known as medphalan, which is less active against certain animal tumors, and the dose needed to produce effects on chromosomes is larger than that required with the L-isomer. Melphalan is available in form suitable for oral administration and has been used to treat multiple myeloma. Available evidence suggests that about one third to one half of the patients with multiple myeloma show a favorable response to oral administration of the drug. Melphalan has been used in the treatment of epithelial ovarian carcinoma.

Cyclophosphamide is stable in the gastrointestinal tract, tolerated well and effective by the oral and parental routes and does not cause local vesication, necrosis, phlebitis or even pain. Chlorambucil, a bifunctional alkylating agent of the nitrogen mustard type that has been found active against selected human neoplastic diseases. Chlorambucil is indicated in the treatment of chronic lymphatic (lymphocytic) leukemia, malignant lymphomas including lymphosarcoma, giant follicular lymphoma and Hodgkin's disease. It is not curative in any of these disorders but may produce clinically useful palliation.

Other factors that cause DNA damage and have been used extensively include what are commonly known as gamma-rays, X-rays, and/or the directed delivery of radioisotopes to tumor cells. Other forms of DNA damaging factors are also contemplated such as microwaves and UV-irradiation. It is most likely that all of these factors effect a broad range of damage DNA, on the precursors of DNA, the replication and repair of DNA, and the assembly and maintenance of chromosomes. Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half-life of the isotope, the strength and type of radiation emitted, and the uptake by the neoplastic cells. (See, e.g., Remington's Pharmaceutical Sciences" 15th Edition, chapter 33, in particular pages 624-652.) Some variation in dosage will necessarily occur depending on the condition of the subject being treated. The person responsible for administration will, in any event, determine the appropriate dose for the individual subject. Moreover, for human administration, preparations should meet sterility, pyrogenicity, general safety and purity standards as required by FDA Office of Biologics standards.

In addition to combining chimeric peptide-based therapies with chemo- and radiotherapies, it also is contemplated that combination with gene therapies will be advantageous. For example, targeting of chimeric peptide-based therapies and p53 or p16 mutations at the same time may produce an improved anti-cancer treatment. Any other tumor-related gene conceivably can be targeted in this manner, for example, p21, Rb, APC, DCC, NF-1, NF-2, BCRA2, p16, FHIT, WT-1, MEN-I, MEN-II, BRCA1, VHL, FCC, MCC, ras, myc, neu, raf erb, src, fins, jun, trk, ret, gsp, hst, bcl and abl.

In addition to the anticancer therapeutics discussed above, it is contemplated that the peptides of the invention may be combined with other angiogenesis inhibitors. The peptides of the present invention are expected to have both anti-lymphangiogenic and anti-angiogenic properties. Many anti-angiogenic drugs also may have anti-lymphangiogenic properties. http://cancertrials.nci.nih.gov/news/angio is a website maintained by the National Institutes of Health which provides current information on the trials presently being conducted with anti-angiogenic agents. These agents include, for example, Marimastat (British Biotech, Annapolis Md.; indicated for non-small cell lung, small cell lung and breast cancers); AG3340 (Agouron, LaJolla, Calif.; for glioblastoma multiforme); COL-3 (Collagenex, Newtown Pa.; for brain tumors); Neovastat (Aetema, Quebec, Canada; for kidney and non-small cell lung cancer) BMS-275291 (Bristol-Myers Squibb, Wallingford Conn.; for metastatic non-small cell ling cancer); Thalidomide (Celgen; for melanoma, head and neck cancer, ovarian, metastatic prostate, and Kaposi's sarcoma; recurrent or metastatic colorectal cancer (with adjuvants); gynecologic sarcomas, liver cancer; multiple myeloma; CLL, recurrent or progressive brain cancer, multiple myeloma, non-small cell lung, nonmetastatic prostate, refractory multiple myeloma, and renal cancer); Squalamine (Magainin Pharmaceuticals Plymouth Meeting, Pa.; non-small cell cancer and ovarian cancer); Endostatin (EntreMEd, Rockville, Md.; for solid tumors); SU5416 (Sugen, San Francisco, Calif.; recurrent head and neck, advanced solid tumors, stage IIIB or IV breast cancer; recurrent or progressive brain (pediatric); Ovarian, AML; glioma, advanced malignancies, advanced colorectal, von-Hippel Lindau disease, advanced soft tissue; prostate cancer, colorectal cancer, metastatic melanoma, multiple myeloma, malignant mesothelioma: metastatic renal, advanced or recurrent head and neck, metastatic colorectal cancer); SU6668 (Sugen San Francisco, Calif.; advanced tumors); interferon-α; Anti-VEGF antibody (NAtional Cancer Institute, Bethesda Md.; Genentech San Franscisco, Calif.; refractory solid tumors; metastatic renal cell cancer, in untreated advanced colorectal); EMD121974 (Merck KCgaA, Darmstadt, Germany; HIV related Kaposi's Sarcoma, progressive or recurrent Anaplastic Glioma); Interleukin 12 (Genetics Institute, Cambridge, Mass.; Kaposi's sarcoma) and IM862 (Cytran, Kirkland, Wash.; ovarian cancer, untreated metastatic cancers of colon and rectal origin and Kaposi's sarcoma). The parenthetical information following the agents indicates the cancers against which the agents are being used in these trials. It is contemplated that any of these disorders may be treated with the peptides of the present invention either alone or in combination with the agents listed.

Additional features of the invention will be apparent from the following Examples.

EXAMPLE 1

Construction of VEGF-A/VEGF-C Hybrid Molecules

Although the amino acid residues of the receptor binding domain of VEGF family members are share conserved motifs, these proteins exhibit different receptor specificities. In the following experiment, DNA molecules encoding polypeptides containing different portions of the receptor binding domains of either VEGF-A or VEGF-C were constructed using a combinatorial approach to create novel hybrid molecules with unique structural and functional characteristics.

To generate the novel molecules, the nucleotide sequences of VEGF-A and mature VEGF-C were analyzed to determine localized regions of nucleotide identity which would be suitable for designing short DNA fragments which could be synthesized and readily recombined. Eight corresponding regions of identity were selected in each molecule as sites for fragmentization (into nine fragments) and recombination into chimeric (hybrid) molecules. These fragmentation sites were chosen based on nucleotide sequence and also because the resultant fragments would correspond to structural elements (e.g., alpha helix, loop, etc.) based on the crystal structure of VEGF-A (see FIG. 1).

Fragmentation of VEGF-A

Nine pairs of synthetic oligonucleotides were designed based on the coding sequence for $VEGF_{121}$, for the purpose of forming nine DNA fragments that encompass the receptor binding domain encoding region of VEGF-A (corresponding to nucleotides 156 to 461 of SEQ ID NO: 1, which encode amino acid residues 34 to 135 of SEQ ID NO: 2). Each oligonucleotide pair comprised a forward primer containing coding sequence and a reverse primer with nucleotide sequence complementary to a portion of the forward primer, to permit annealing of the primers to each other into a double-stranded DNA fragment. Either the forward or reverse primer of each pair also included a short 5' and 3' nucleotide sequence that was not complementary to any sequence of its paired primer. These short additional sequences correspond to the localized regions of nucleotide identity set forth above. Following annealing of primer pairs, this additional sequence formed single-stranded overhangs compatible with annealing with other double-stranded annealed primer pairs, as described in greater detail below. The nucleotide sequences from the VEGF-A forward and reverse primers are set forth below in Tables 1A and 1B, respectively.

TABLE 1A

| Forward (Coding) Primers for VEGF-A | |
|---|---|
| A1-F | **gat cCT** GGG CAG AAT CAT CAC GAA GTG Gtg aaa t |
| | D P G Q N H H E V V K |
| A2-F | TC ATG GAT GTC TAT CAG CGC AGC TAC TGC CAT |
| | F M D V Y Q R S Y C H |
| A3-F | ccg aTC GAG ACA CTG GTG GAC ATC TTC CAG GAATAGAAGAGC |
| | P I E T L V D I F Q |
| A4-F | CGCTCTTCGAA TAC CCT GAT GAG ATC GAG TAC A |
| | E Y P D E I E Y |
| A5-F | tc ttc aag cca TCC TGC GTG CCC CTG ATG AGA TGT GGC |
| | I F K P S C V P L M R C G |
| A6-F | CCG GGT TGC TGC AAT GAC GAA GGG CTG G |
| | G C C N D E G L |
| A7-F | ag tgC GTT CCC ACC GAG GAG TCC AAC ATC ACC ATG CAG ATT ATG AG |
| | E C V P T E E S N I T M Q I M R |

TABLE 1A-continued

Forward (Coding) Primers for VEGF-A

```
A8-F a att AAA CCT CAC CAA GGG CAG CAC ATC GGA GAG ATG agc ttt
        I   K   P   H   Q   G   Q    H   I   G   E   M   S   F

A9-F CTC CAG CAT AAC AAA TGT GAA TGT AGA CCA AAG AAA GATTGAGTCTTCGC
      L   Q   H   N   K   C   E    C   R   P   K   K   D
```

The nucleotide sequences of forward primers A1-F to A9-F are set forth in SEQ ID NOs: 3-11, respectively. For each of the primers listed, the top strand shows the DNA sequence and the bottom strand indicates the amino acids encoded by that particular primer, SEQ ID NOs: 128-136, respectively. In some instances, only two nucleotides of a given codon is contained in one primer, and the remaining nucleotide of the codon is contained in the preceding or following primer. In these cases, the amino acid is listed under the primer that contains 2 out of the 3 nucleotides of that particular codon. Boldface type indicate nucleotides coding for amino acids that constitute a protein linker region and are not part of the parent VEGF-A or VEGF-C molecule; underlined nucleotides are those that are removed during assembly of the fragments into hybrid constructs; and the lowercase letters are those nucleotides that produce an overhang when the oligonucleotide pairs are annealed to each other to produce the 9 fragments.

TABLE 1B

Reverse (Non-Coding) Primers for VEGF-A

A1-R CCACTTCGTGATGATTCTGCCCAG

A2-R tcggATGGCAGTAGCTGCGCTGATAGACATCCATGAatttca

A3-R tcgaGCTCTTCTATTCCTGGAAGATGTCCACCAGTGTCTCGA

A4-R tggcttgaagatGTACTCGATCTCATCAGGGTATTCGAAGAGCGgtac

A5-R catgGCCACATCTCATCAGGGGCACGCAGGA

A6-R gcactCCAGCCCTTCGTCATTGCAGCAACCCGGGTAC

A7-R aattCTCATAATCTGCATGGTGATGTTGGACTCCTCGGTGGGAAC

A8-R CATCTCTCCGATGTGCTGCCCTTGGTGAGGTTT

A9-R GGCCGCGAAGACTCAATCTTTCTTTGGTCTACATTCACATTTGTTATGCTGGAGaaagct

The nucleotide sequences of reverse primers A1-R to A9-R are set forth in SEQ ID NOs: 12-20, respectively. Boldface, underlined and lowercase letters are used as described in Table 1A.

Nine VEGF-A polynucleotide fragments were assembled by annealing a matched pair of synthetic oligonucleotide primers. For example, fragment A1 was created by annealing primer A1-F with primer A1-R, fragment A2 was created by annealing A2-F with A2-R, and so on. Annealing was accomplished by incubating 2 pmol/μl of each appropriate primer, 20 mM Tris/HCl, 2 mM $MgCl_2$, and 50 mM NaCl, pH 7.4 at 95° C. for 5 minutes, followed by cooling of the solution to 37° C. at a rate of 1° C./minute. As shown in Table 1A, fragment A1 encodes amino acid residues 34 to 42, and part of amino acid 43 of SEQ ID NO: 2; fragment A2 encodes part of amino acid 43, and amino acids 44-53 of SEQ ID NO: 2; fragment A3 encodes amino acids 54 to 63, and part of amino acid 64 of SEQ ID NO: 2; fragment A4 encodes part of amino acid 64, amino acids 65 to 71, and part of amino acid 72 of SEQ ID NO: 2; fragment A5 encodes part of amino acid 72, amino acids 73 to 83, and part of amino acid 84 of SEQ ID NO: 2; fragment A6 encodes part of amino acid 84, amino acids 85 to 92, and part of amino acid 93 of SEQ ID NO: 2; fragment A7 encodes part of amino acid 93, amino acids 94 to 107, and part of amino acid 108 of SEQ ID NO: 2; fragment A8 encodes part of amino acid 108, and amino acids 109 to 122 of SEQ ID NO: 2; and fragment A9 encodes amino acids 123 to 135 of SEQ ID NO: 2.

Fragmentation of VEGF-C

In a similar manner, nine pairs of oligonucleotides were designed and synthesized based upon the amino acid sequence of the receptor binding domain of VEGF-C (corresponding to nucleotides 658 to 999 of SEQ ID NO: 21, which encode amino acid residues 112 to 216 of SEQ ID NO: 22). The nucleotide sequences of the nine forward primers and nine reverse primers are set forth in Table 2A (SEQ ID NOs: 23-31) and Table 2B (SEQ ID NOs: 32-40), respectively. The amino acid sequences encoded by the nine forward primers are set forth in SEQ ID NOs: 137-145, respectively.

TABLE 2A

| Forward (Coding) Primers for VEGF-C | |
|---|---|
| C1-F | **gat cCT** GCA CAT TAT AAT ACC GAG ATC Ctg aaa t |
| | D P A H Y N T E I L K |
| C2-F | CT ATT GAT AAT GAG TGG AGA AAG ACT CAG TGC ATG |
| | S I D N E W R K T Q C M |
| C3-F | ccg aGA GAG GTG TGT ATC GAC GTG GGG AAG GAATAGAAGAGC |
| | P R E V C I D V G K |
| C4-F | CGCTCTTCGAA TTT GGA GTC GCG ACA AAC ACC T |
| | E F G V A T N T |
| C5-F | tc ttc aag cca CCA TGT GTG TCC GTG TAC AGA TGT GGC |
| | F F K P P C V S V Y R C G |
| C6-F | CCG GGT TGC TGC AAT AGT GAG GGG CTG C |
| | G C C N S E G L |
| C7-F | ag tgc ATG AAC ACG TCC ACG AGC TAC CTC AGC AAG ACG CTG TTT GA |
| | Q C M N T S T S Y L S K T L F E |
| C8-F | a att ACA GTG CCT CTC TCT CAA GGG CCC AAA CCA GTG ACA ATC agcttt |
| | I T V P L S Q G P K P V T I S F |
| C9-F | GCC AAT CAC ACT TCC TGC CGA TGC ATG TCT AAG CTG GATTGAGTCTTCGC |
| | A N H T S C R C M S K L D |

TABLE 2B

| Forward (Coding) Primers for VEGF-C | |
|---|---|
| C1-R | GGATCTCGGTATTATAATGTGC**AG** |
| C2-R | tcggCATGCACTGAGTCTTTCTCCACTCATTATCAATAGatttca |
| C3-R | tcgaGCTCTTCTATTCCTTCCCCACGTCGATACACACCTCTC |
| C4-R | tggcttgaagaAGGTGTTTGTCGCGACTCCAAATTCGAAGAGCGgtac |
| C5-R | catgGCCACATCTGTACACGGACACACATGG |
| C6-R | gcactGCAGCCCCTCACTATTGCAGCAACCCGGgtac |
| C7-R | aattTCAAACAGCGTCTTGCTGAGGTAGCTCGTGGACGTGTTCAT |
| C8-R | GATTGTCACTGGTTTGGGCCCTTGAGAGAGAGGCACTGT |
| C9-R | ggccGCGAAGACTCAATCCAGCTTAGACATGCATCGGCAGGAAGTGTGATTGGCaaagct |

Boldface, underlined and lowercase letters are used in Tables 2A and 2B as described in Table 1A.

Primer pairs were annealed to form nine double-stranded DNA fragments which together encoded the receptor binding domain of VEGF-C, and which possessed appropriate single stranded overhangs for annealing to other fragments, as described above for VEGF-A.

Fragment C1 encodes amino acid residues 112 to 120, and part of amino acid 121 of SEQ ID NO: 22; fragment C2 encodes part of amino acid 121 and amino acids 122 to 132 of SEQ ID NO: 22; fragment C3 encodes amino acids 133 to 142, and part of amino acid 143 of SEQ ID NO: 22; fragment C4 encodes part of amino acid 143, amino acids 144 to 150, and part of amino acid 151 of SEQ ID NO: 22; fragment C5 encodes part of amino acid 151, amino acids 152 to 162, and part of amino acid 163 of SEQ ID NO: 22; fragment C6 encodes part of amino acid 163, and amino acids 164 to 171, and part of amino acid 172 of SEQ ID NO: 22; fragment C7 encodes part of amino acid 172, amino acids 173 to 186, and part of amino acid 187 of SEQ ID NO: 22; fragment C8 encodes part of amino acid 187, amino acid 188 to 203 of SEQ ID NO: 22; and fragment C9 encodes amino acid 204 to 216 of SEQ ID NO: 22.

Discussion Regarding the Synthesis of the VEGF-A and VEGF-C Fragments

Figure 2:
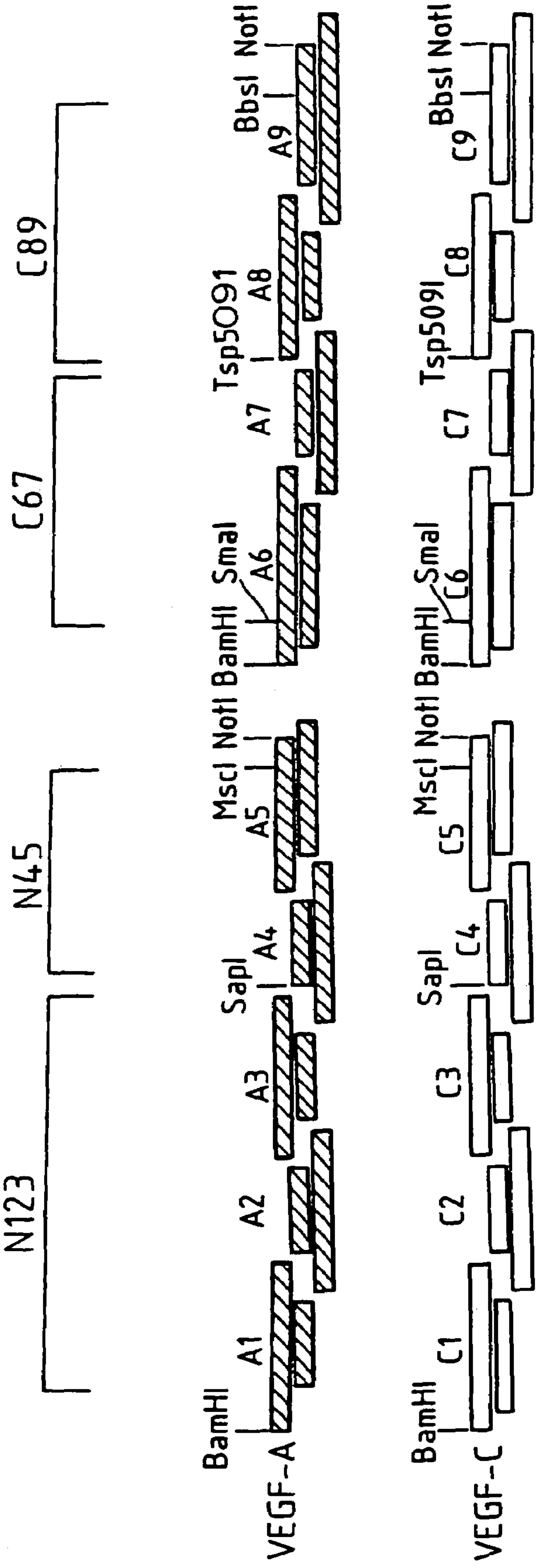
FIG. 2 is a schematic diagram of the 9 VEGF-A and 9 VEGF-C DNA fragments used to construct the VEGF-A/VEGF-C hybrid molecules. These fragments are numbered 1 through 9 on top. The N123, N45, C67 and C89 groups of fragments are also indicated. N123 consists of 3 VEGF-A fragments and 3 VEGF-C fragments (fragments 1-3), whereas N45 (fragments 4-5), C67 (fragments 6-7), and C89 (fragments 8-9) each consist of 2 VEGF-A fragments and 2 VEGF-C fragments. Selected restriction endonuclease sites also are depicted.

Thus, by synthesizing and annealing nine pairs of primers designed from the VEGF-A amino acid sequence and nine pairs of primers designed from the VEGF-C amino acid sequence, eighteen DNA fragments were generated. FIG. 2 is a schematic diagram illustrating the construction of the 9 VEGF-A and 9 VEGF-C DNA fragments. The oligonucleotides were designed to produce double-stranded DNA fragments containing unique cohesive ends upon annealing. Ligation of the 9 VEGF-A DNA fragments produces a single linear double-stranded DNA encoding amino acids 34-135 of VEGF-A (SEQ ID NO: 2), and ligation of the 9 VEGF-C DNA fragments results in a single DNA encoding amino acids 112-216 of VEGF-C (SEQ ID NO: 22).

While the insertion of cohesive ends greatly facilitated ligation of fragments in a desired order and orientation, it will be appreciated that ligation of fragments can also be accomplished without cohesive ends. Blunt-end fragments also can be synthesized and annealed to generate hybrid proteins using the method described above. With a blunt-end strategy, the nucleotide sequences of the parent molecules do not need to be examined for the presence of nucleotide identity to enable the creation of cohesive ends. However, additional post-ligation screening may be required to identify hybrids that contain fragments in the desired order and orientation.

Several additional details regarding the synthetic primers and the double-stranded DNA fragments deserve emphasis. First, it is worth noting that, for VEGF-A fragment A1 and VEGF-C fragment C1, the first two encoded amino acids, Asp and Pro, constitute a protein linker (encoded by an engineered BamHI recognition site) and do not correspond to either VEGF-A or VEGF-C sequences.

Second, referring to FIGS. 1 and 2, it is noteworthy that many of the fragments were designed to correspond to discrete structural elements within the receptor binding domain of VEGF family proteins. Fragment 2 corresponds to the N-terminal helix; fragment 4 corresponds to β2; fragment 6 corresponds to the β3-β4 loop, fragment 7 corresponds to β5; fragment 8 corresponds to the β5-β6 loop; and fragment 9 corresponds to β7.

Third, it is noteworthy that the thirty-six oligonucleotides that were designed do not correspond exactly with native human VEGF-A or VEGF-C cDNA sequences (i.e., DNA counterparts of naturally-occurring human mRNA sequences), notwithstanding the fact that the oligonucleotides were designed to retain encoded amino acid sequences of the human VEGF-A and VEGF-C polypeptides. For example, the oligonucleotides were designed such that the native (endogenous) human nucleotide sequence encoding the receptor binding domain for both VEGF-A and VEGF-C were modified to generate new restriction sites, to provide longer stretches of nucleotide identity where overlaps were desired between the "A" and "C" fragments, or to improve codon usage for expression in human cell culture. All nucleotide mutations (relevant to the native sequences) were silent. Thus, the amino acid sequences of the receptor binding domain of VEGF-A (resulting from annealing fragments A1-A9) and VEGF-C (from annealing fragments-C1-C9) are identical to that of the respective parent molecule.

Fourth, referring again to FIG. 2, it is noteworthy that each of the nine VEGF-A fragments aligns with the corresponding VEGF-C fragment, and has a compatible cohesive end to anneal to adjacent fragments from the other molecule. For example, fragments A1 and C1 correspond to the same relative portions of VEGF-A and VEGF-C, respectively, and have identical top strand cohesive ends. These cohesive ends are exactly complementary to bottom strand cohesive ends of both fragments A2 and C2, such that A1 could anneal to either A2 or C2, and C1 also could anneal to A2 or C2. Fragments A2 and C2 correspond to the same relative portions of VEGF-A and VEGF-C, and each possesses another bottom strand cohesive end that is exactly complementary to top strand cohesive ends of fragments A3 and C3, and so on. Thus, each set of nine fragments was designed not only to anneal to adjacent fragments of its parent VEGF-A/VEGF-C molecule, but also to anneal to adjacent fragments of the other molecule.

Assembly of Chimeric (Hybrid) VEGF Molecules

Assembly of the 9 VEGF-A and 9 VEGF-C DNA fragments into hybrid DNAs containing regions from both VEGF-A and VEGF-C was accomplished by ligating different combinations of the VEGF-A and VEGF-C DNA fragments. All DNA fragments were isolated after digestion with appropriate restriction enzymes and gel electrophoresis using Qiaex II beads (Qiagen). It will be apparent that, if the proper order (1-2-3-4-5-6-7-8-9) of fragments is preserved, the nine VEGF-A fragments and the nine VEGF-C fragments can be recombined and annealed into 512 distinct hybrids, two of which represent naturally-occurring sequences (A1-A2-A3-A4-A5-A6-A7-A8-A9 and C1-C2-C3-C4-C5-C6-C7-C8-C9) and 510 of which represent novel hybrids. All 512 sequences were reconstructed using the following three step process.

First, the receptor binding domains of VEGF-A and VEGF-C were divided into 4 subdomains designated N123, N45, C67 and C89, as shown in FIG. 2. N123 consists of the first 3 DNA fragments encoding the receptor binding domain of both VEGF-A and VEGF-C. N45, C67 and C89 each consists of 2 DNA fragments where N45 includes fragments 4 and 5, C67 consists of fragments 6 and 7, and C89 includes fragments 8 and 9.

Figure 4:
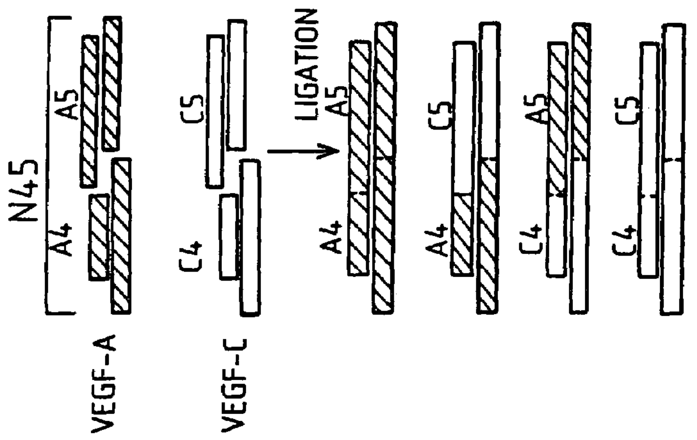
FIG. 4 schematically depicts all 4 possible DNA molecules corresponding to the N45 region resulting from ligating different combinations of fragments 4 and 5 from VEGF-A and VEGF-C.
Figure 3:
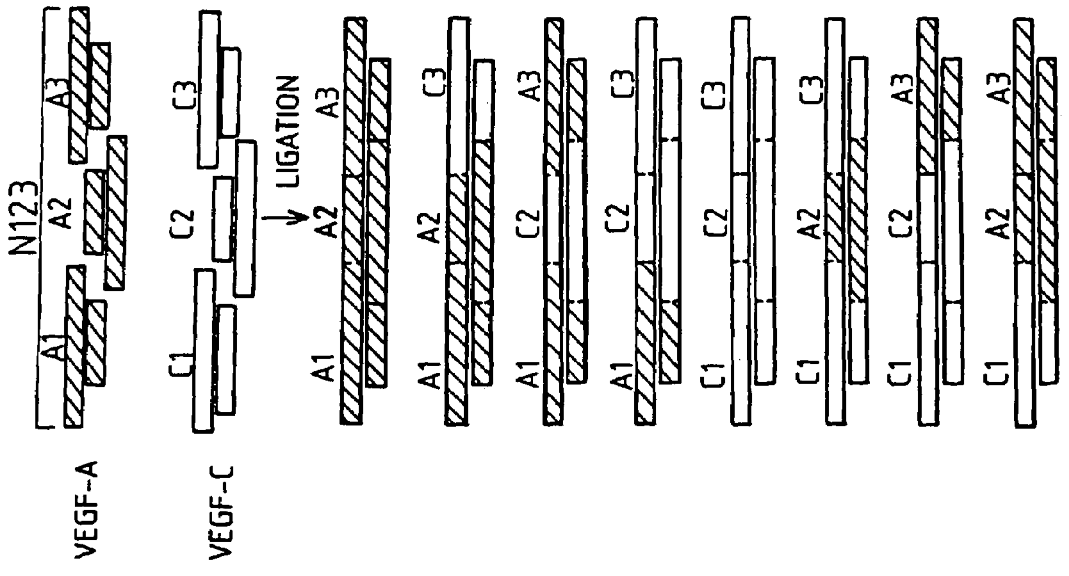
FIG. 3 schematically depicts all 8 possible DNA molecules corresponding to the N123 region, resulting from ligating different combinations of fragments 1,2, and 3 from VEGF-A (A1, A2, and A3) and VEGF-C (C1, C2, and C3).
Figure 6:
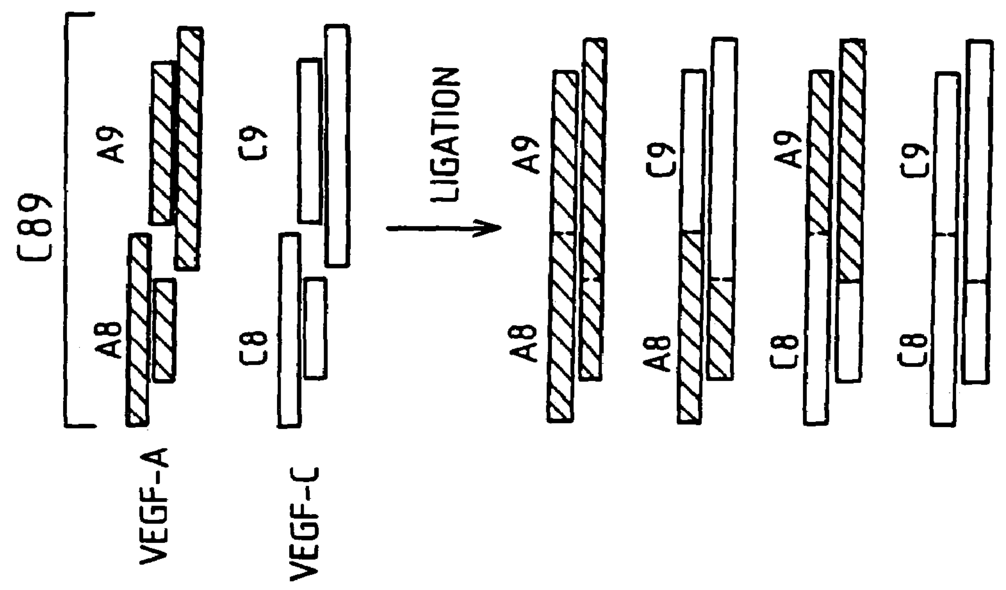
FIG. 6 schematically depicts all 4 possible DNA molecules corresponding to the C89 region resulting from ligating different combinations of fragments 8 and 9 from VEGF-A and VEGF-C.
Figure 5:
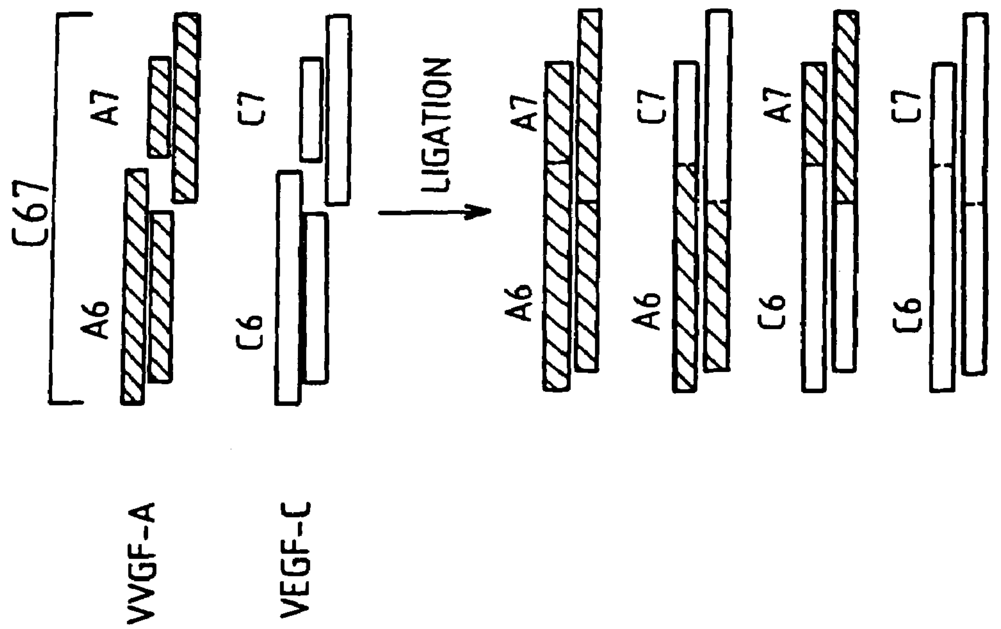
FIG. 5 schematically depicts all 4 possible DNA molecules corresponding to the C67 region resulting from ligating different combinations of fragments 6 and 7 from VEGF-A and VEGF-C.
Figures 7A, 7B, 7C, 7D:
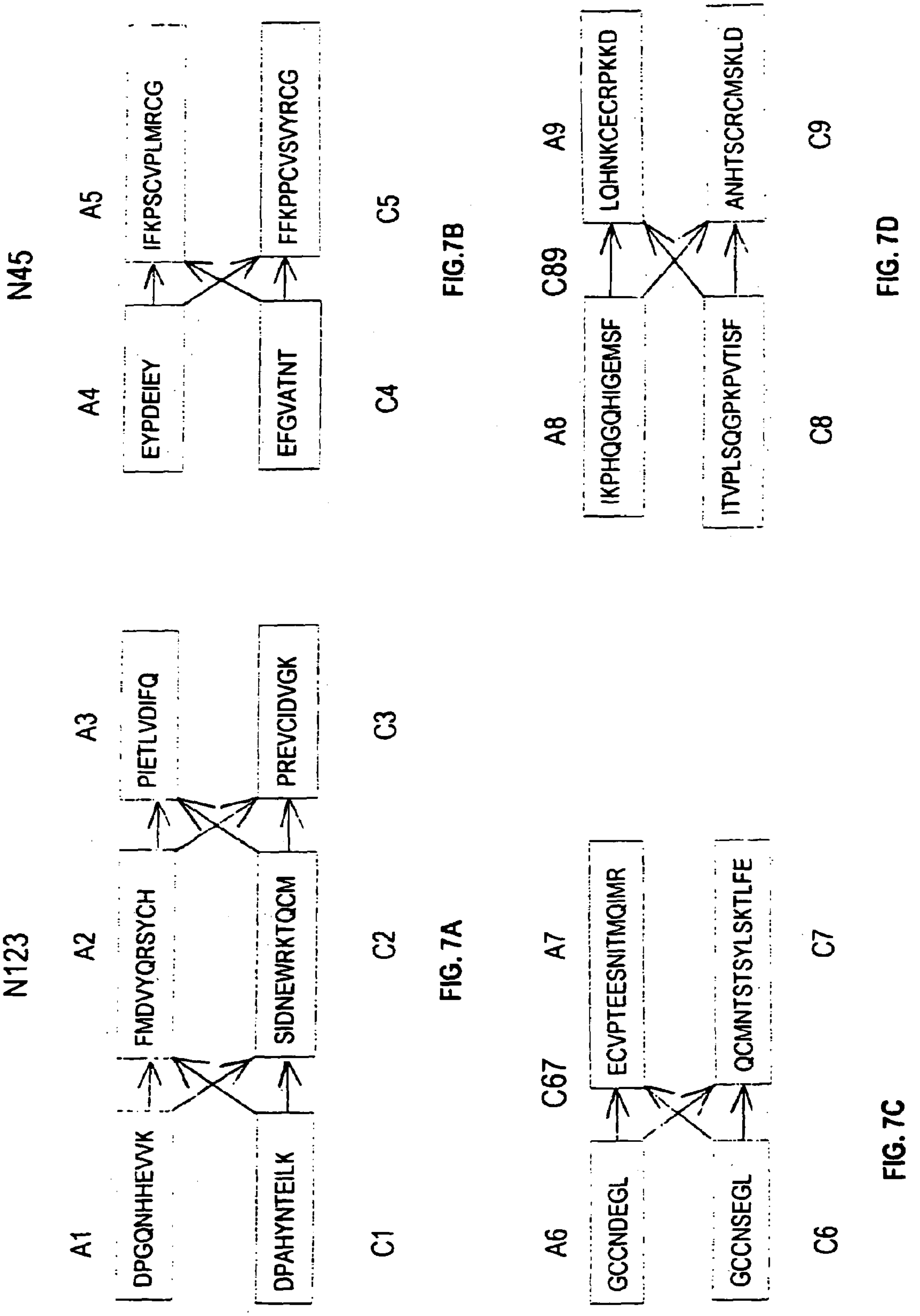
FIGS. 7A-7D depict in boxes the amino acid sequences encoded by DNA fragments A1-A9 (SEQ ID NOs: 128-136) and C1-C9 (SEQ ID NOs: 137-145), and depict the manner in which longer encoded amino acid sequences were formed through the joining of fragments A1-A3 and C1-C3 in the N123 ligation (FIG. 7A); of fragments A4-A5 and C4-C5 in the N45 ligation (FIG. 7B); of fragments A6-A7 and C6-C7 in the C67 ligation; and of fragments A8-A9 and C8-C9 in the C89 ligation. In each figure, arrows represent peptide bonds between encoded amino acid sequences that result from proper ligation of compatible DNA fragments and translation of the resultant ligated DNA.

Continuous DNA's corresponding to the N123 region were constructed by ligating fragments 1, 2, and 3 from either VEGF-A or VEGF-C, thus producing a total of eight possible different N123 DNA segments shown schematically in FIG. 3. Similarly, continuous DNAs corresponding to the N45, C67, and C89 regions were constructed by ligating the two appropriate DNA fragments from VEGF-A or VEGF-C. In these cases, all four possible different molecules were produced for each of the regions. FIG. 4 is a schematic diagram illustrating all four possible N45 DNA segments, FIG. 5 depicts all four possible C67 DNA segments, and FIG. 6 shows all four possible C89 DNA segments. All of these molecules were cloned into the multiple cloning site of the pKO-Scrambler-V912-BX vector (Lexicon Genetics Inc.) as part of the ligation reaction. All ligations were carried out by combining 8 nmol/μl of vector cut with the appropriate restriction enzyme that enables cloning of the inserts into the vector, and dephosphorylated; 80 nmol/μl each of DNA fragments that are to be inserted into the vector; and 5 Weiss Units of T4 DNA ligase in 50 mM Tris/HCl, 10 mM $MgCl_2$, 10 mM DTT, 1 mM ATP, 25 μg/ml BSA, and 5% PEG-4000, pH 7.5, followed by incubation for 12 hours at 16° C. FIGS. 7A-7D depict the amino acid sequences encoded by each of fragments A1-A9 and C1-C9; and schematically depict all the permutations of encoded peptides that result from recombinations that form the eight N123 constructs (FIG. 7A), four N45 constructs (FIG. 7B), four C67 constructs (FIG. 7C), and four C89 constructs (FIG. 7D).

In the second step, the N123 fragments were joined with N45 fragments, and the C67 fragments were joined with C89 fragments. The N123 and N45 fragments were removed from their pKO-Scrambler-V912 host vector by digestion with restriction enzymes that allowed ligation of N123 to N45, and which also achieved removal of the non-protein coding regions of fragments 3 and 4 (see Tables 1A, 1B, 2A and 2B). By ligating each of the eight different N123 regions to all four possible N45 regions, 32 distinct N-terminal portions of the receptor binding domains were obtained. These clones were further inserted into the pSecTagI vector (SEQ ID NO: 41). The pSecTagI vector is a combined *E. coli*/mammalian expression vector which was constructed by modifying the pSecTagA vector (Invitrogen). pSecTagA was modified to eliminate specific restriction sites using site-directed mutagenesis and synthetic linkers, and the EM7 promoters from pICZα-A (Invitrogen) and pTRACER-CMV were added downstream to the CMV promoter of pSecTagA. Both pSecTagI and it's parent vector, pSecTagA, allow high level of expression in mammalian cell culture using suitable cell lines e.g., 293T cells, zeocin selection of stably transfected mammalian cells, contain a mammalian signal peptide for secretion of the expressed protein, and contain a C-terminal myc epitope and polyhistidine tag for detection, quantitation and purification of the expressed protein. The pSecTagI vector differs from the pSpecTagA vector in that expression in *E. coli* is constitutive and modification of the restriction sites facilitated cloning of the hybrid constructs.

The C67 and C89 fragments were removed from their pKO-Scrambler-V912 host vector by digestion with appropriate restriction enzymes, which also achieved removal of the non-protein coding regions of fragments 6 and 9 (see Tables 1A, 1B, 2A and 2B). Ligation of the four different C67 molecules to the four different C89 molecules produced 16 distinct C-terminal halves of the receptor binding domain. The C67-C89 fragments were cloned into the pKO-Scrambler vector during these ligations. Finally, 512 final ligations that combined the 32 different N-terminal portions and the 16 distinct C-terminal regions resulted in a total of 512 distinct molecules of which 510 are hybrids composed of both VEGF-A and VEGF-C amino acid residues. During this step the 512 constructs were cloned into the pSecTagI vector which contained the 32 different N-terminal portions. The remaining 2 molecules correspond to the original VEGF-A and VEGF-C sequences encoding the receptor binding domain. The predicted nucleotide and amino acid sequences for all 512 hybrid molecules are set forth in the sequence listing as summarized in Table 2.5.

TABLE 2.5

| VEGF-A/VEGF-C* Chimera | Predicted DNA Sequence Seq ID NO: | Predicted Protein Sequence Seq ID NO: |
|---|---|---|
| AAAAAAAAA | 176 | 177 |
| CAAAAAAAA | 178 | 179 |
| ACAAAAAAA | 180 | 181 |
| CCAAAAAAA | 182 | 183 |
| AACAAAAAA | 184 | 185 |
| CACAAAAAA | 186 | 187 |
| ACCAAAAAA | 188 | 189 |
| CCCAAAAAA | 190 | 191 |
| AAACAAAAA | 192 | 193 |
| CAACAAAAA | 194 | 195 |
| ACACAAAAA | 196 | 197 |
| CCACAAAAA | 198 | 199 |
| AACCAAAAA | 200 | 201 |
| CACCAAAAA | 202 | 203 |
| ACCCAAAAA | 204 | 205 |
| CCCCAAAAA | 206 | 207 |
| AAAACAAAA | 208 | 209 |
| CAAACAAAA | 210 | 211 |
| ACAACAAAA | 212 | 213 |
| CCAACAAAA | 214 | 215 |
| AACACAAAA | 216 | 217 |
| CACACAAAA | 218 | 219 |
| ACCACAAAA | 220 | 221 |
| CCCACAAAA | 222 | 223 |
| AAACCAAAA | 224 | 225 |
| CAACCAAAA | 226 | 227 |
| ACACCAAAA | 228 | 229 |
| CCACCAAAA | 230 | 231 |
| AACCCAAAA | 232 | 233 |
| CACCCAAAA | 234 | 235 |
| ACCCCAAAA | 236 | 237 |
| CCCCCAAAA | 238 | 239 |

TABLE 2.5-continued

| VEGF-A/VEGF-C* Chimera | Predicted DNA Sequence Seq ID NO: | Predicted Protein Sequence Seq ID NO: |
|---|---|---|
| AAAAACAAA | 240 | 241 |
| CAAAACAAA | 242 | 243 |
| ACAAACAAA | 244 | 245 |
| CCAAACAAA | 246 | 247 |
| AACAACAAA | 248 | 249 |
| CACAACAAA | 250 | 251 |
| ACCAACAAA | 252 | 253 |
| CCCAACAAA | 254 | 255 |
| AAACACAAA | 256 | 257 |
| CAACACAAA | 258 | 259 |
| ACACACAAA | 260 | 261 |
| CCACACAAA | 262 | 263 |
| AACCACAAA | 264 | 265 |
| CACCACAAA | 266 | 267 |
| ACCCACAAA | 268 | 269 |
| CCCCACAAA | 270 | 271 |
| AAAACCAAA | 272 | 273 |
| CAAACCAAA | 274 | 275 |
| ACAACCAAA | 276 | 277 |
| CCAACCAAA | 278 | 279 |
| AACACCAAA | 280 | 281 |
| CACACCAAA | 282 | 283 |
| ACCACCAAA | 284 | 285 |
| CCCACCAAA | 286 | 287 |
| AAACCCAAA | 288 | 289 |
| CAACCCAAA | 290 | 291 |
| ACACCCAAA | 292 | 293 |
| CCACCCAAA | 294 | 295 |
| AACCCCAAA | 296 | 297 |
| CACCCCAAA | 298 | 299 |
| ACCCCCAAA | 300 | 301 |
| CCCCCCAAA | 302 | 303 |
| AAAAAACAA | 304 | 305 |
| CAAAAACAA | 306 | 307 |
| ACAAAACAA | 308 | 309 |
| CCAAAACAA | 310 | 311 |
| AACAAACAA | 312 | 313 |
| CACAAACAA | 314 | 315 |
| ACCAAACAA | 316 | 317 |
| CCCAAACAA | 318 | 319 |
| AAACAACAA | 320 | 321 |
| CAACAACAA | 322 | 323 |
| ACACAACAA | 324 | 325 |
| CCACAACAA | 326 | 327 |
| AACCAACAA | 328 | 329 |
| CACCAACAA | 330 | 331 |
| ACCCAACAA | 332 | 333 |
| CCCCAACAA | 334 | 335 |
| AAAACACAA | 336 | 337 |
| CAAACACAA | 338 | 339 |
| ACAACACAA | 340 | 341 |
| CCAACACAA | 342 | 343 |
| AACACACAA | 344 | 345 |
| CACACACAA | 346 | 347 |
| ACCACACAA | 348 | 349 |
| CCCACACAA | 350 | 351 |
| AAACCACAA | 352 | 353 |
| CAACCACAA | 354 | 355 |
| ACACCACAA | 356 | 357 |
| CCACCACAA | 358 | 359 |
| AACCCACAA | 360 | 361 |
| CACCCACAA | 362 | 363 |
| ACCCCACAA | 364 | 365 |
| CCCCCACAA | 366 | 367 |
| AAAAACCAA | 368 | 369 |
| CAAAACCAA | 370 | 371 |
| ACAAACCAA | 372 | 373 |
| CCAAACCAA | 374 | 375 |
| AACAACCAA | 376 | 377 |
| CACAACCAA | 378 | 379 |
| ACCAACCAA | 380 | 381 |
| CCCAACCAA | 382 | 383 |
| AAACACCAA | 384 | 385 |
| CAACACCAA | 386 | 387 |
| ACACACCAA | 388 | 389 |
| CCACACCAA | 390 | 391 |

TABLE 2.5-continued

| VEGF-A/VEGF-C* Chimera | Predicted DNA Sequence Seq ID NO: | Predicted Protein Sequence Seq ID NO: |
|---|---|---|
| AACCACCAA | 392 | 393 |
| CACCACCAA | 394 | 395 |
| ACCCACCAA | 396 | 397 |
| CCCCACCAA | 398 | 399 |
| AAAACCCAA | 400 | 401 |
| CAAACCCAA | 402 | 403 |
| ACAACCCAA | 404 | 405 |
| CCAACCCAA | 406 | 407 |
| AACACCCAA | 408 | 409 |
| CACACCCAA | 410 | 411 |
| ACCACCCAA | 412 | 413 |
| CCCACCCAA | 414 | 415 |
| AAACCCCAA | 416 | 417 |
| CAACCCCAA | 418 | 419 |
| ACACCCCAA | 420 | 421 |
| CCACCCCAA | 422 | 423 |
| AACCCCCAA | 424 | 425 |
| CACCCCCAA | 426 | 427 |
| ACCCCCCAA | 428 | 429 |
| CCCCCCCAA | 430 | 431 |
| AAAAAAACA | 432 | 433 |
| CAAAAAACA | 434 | 435 |
| ACAAAAACA | 436 | 437 |
| CCAAAAACA | 438 | 439 |
| AACAAAACA | 440 | 441 |
| CACAAAACA | 442 | 443 |
| ACCAAAACA | 444 | 445 |
| CCCAAAACA | 446 | 447 |
| AAACAAACA | 448 | 449 |
| CAACAAACA | 450 | 451 |
| ACACAAACA | 452 | 453 |
| CCACAAACA | 454 | 455 |
| AACCAAACA | 456 | 457 |
| CACCAAACA | 458 | 459 |
| ACCCAAACA | 460 | 461 |
| CCCCAAACA | 462 | 463 |
| AAAACAACA | 464 | 465 |
| CAAACAACA | 466 | 467 |
| ACAACAACA | 468 | 469 |
| CCAACAACA | 470 | 471 |
| AACACAACA | 472 | 473 |
| CACACAACA | 474 | 475 |
| ACCACAACA | 476 | 477 |
| CCCACAACA | 478 | 479 |
| AAACCAACA | 480 | 481 |
| CAACCAACA | 482 | 483 |
| ACACCAACA | 484 | 485 |
| CCACCAACA | 486 | 487 |
| AACCCAACA | 488 | 489 |
| CACCCAACA | 490 | 491 |
| ACCCCAACA | 492 | 493 |
| CCCCCAACA | 494 | 495 |
| AAAAACACA | 496 | 497 |
| CAAAACACA | 498 | 499 |
| ACAAACACA | 500 | 501 |
| CCAAACACA | 502 | 503 |
| AACAACACA | 504 | 505 |
| CACAACACA | 506 | 507 |
| ACCAACACA | 508 | 509 |
| CCCAACACA | 510 | 511 |
| AAACACACA | 512 | 513 |
| CAACACACA | 514 | 515 |
| ACACACACA | 516 | 517 |
| CCACACACA | 518 | 519 |
| AACCACACA | 520 | 521 |
| CACCACACA | 522 | 523 |
| ACCCACACA | 524 | 525 |
| CCCCACACA | 526 | 527 |
| AAAACCACA | 528 | 529 |
| CAAACCACA | 530 | 531 |
| ACAACCACA | 532 | 533 |
| CCAACCACA | 534 | 535 |
| AACACCACA | 536 | 537 |
| CACACCACA | 538 | 539 |
| ACCACCACA | 540 | 541 |
| CCCACCACA | 542 | 543 |

TABLE 2.5-continued

| VEGF-A/VEGF-C* Chimera | Predicted DNA Sequence Seq ID NO: | Predicted Protein Sequence Seq ID NO: |
|---|---|---|
| AAACCCACA | 544 | 545 |
| CAACCCACA | 546 | 547 |
| ACACCCACA | 548 | 549 |
| CCACCCACA | 550 | 551 |
| AACCCCACA | 552 | 553 |
| CACCCCACA | 554 | 555 |
| ACCCCCACA | 556 | 557 |
| CCCCCCACA | 558 | 559 |
| AAAAAACCA | 560 | 561 |
| CAAAAACCA | 562 | 563 |
| ACAAAACCA | 564 | 565 |
| CCAAAACCA | 566 | 567 |
| AACAAACCA | 568 | 569 |
| CACAAACCA | 570 | 571 |
| ACCAAACCA | 572 | 573 |
| CCCAAACCA | 574 | 575 |
| AAACAACCA | 576 | 577 |
| CAACAACCA | 578 | 579 |
| ACACAACCA | 580 | 581 |
| CCACAACCA | 582 | 583 |
| AACCAACCA | 584 | 585 |
| CACCAACCA | 586 | 587 |
| ACCCAACCA | 588 | 589 |
| CCCCAACCA | 590 | 591 |
| AAAACACCA | 592 | 593 |
| CAAACACCA | 594 | 595 |
| ACAACACCA | 596 | 597 |
| CCAACACCA | 598 | 599 |
| AACACACCA | 600 | 601 |
| CACACACCA | 602 | 603 |
| ACCACACCA | 604 | 605 |
| CCCACACCA | 606 | 607 |
| AAACCACCA | 608 | 609 |
| CAACCACCA | 610 | 611 |
| ACACCACCA | 612 | 613 |
| CCACCACCA | 614 | 615 |
| AACCCACCA | 616 | 617 |
| CACCCACCA | 618 | 619 |
| ACCCCACCA | 620 | 621 |
| CCCCCACCA | 622 | 623 |
| AAAAACCCA | 624 | 625 |
| CAAAACCCA | 626 | 627 |
| ACAAACCCA | 628 | 629 |
| CCAAACCCA | 630 | 631 |
| AACAACCCA | 632 | 633 |
| CACAACCCA | 634 | 635 |
| ACCAACCCA | 636 | 637 |
| CCCAACCCA | 638 | 639 |
| AAACACCCA | 640 | 641 |
| CAACACCCA | 642 | 643 |
| ACACACCCA | 644 | 645 |
| CCACACCCA | 646 | 647 |
| AACCACCCA | 648 | 649 |
| CACCACCCA | 650 | 651 |
| ACCCACCCA | 652 | 653 |
| CCCCACCCA | 654 | 655 |
| AAAACCCCA | 656 | 657 |
| CAAACCCCA | 658 | 659 |
| ACAACCCCA | 660 | 661 |
| CCAACCCCA | 662 | 663 |
| AACACCCCA | 664 | 665 |
| CACACCCCA | 666 | 667 |
| ACCACCCCA | 668 | 669 |
| CCCACCCCA | 670 | 671 |
| AAACCCCCA | 672 | 673 |
| CAACCCCCA | 674 | 675 |
| ACACCCCCA | 676 | 677 |
| CCACCCCCA | 678 | 679 |
| AACCCCCCA | 680 | 681 |
| CACCCCCCA | 682 | 683 |
| ACCCCCCCA | 684 | 685 |
| CCCCCCCCA | 686 | 687 |
| AAAAAAAAC | 688 | 689 |
| CAAAAAAAC | 690 | 691 |
| ACAAAAAAC | 692 | 693 |
| CCAAAAAAC | 694 | 695 |

TABLE 2.5-continued

| VEGF-A/VEGF-C* Chimera | Predicted DNA Sequence Seq ID NO: | Predicted Protein Sequence Seq ID NO: |
|---|---|---|
| AACAAAAAC | 696 | 697 |
| CACAAAAAC | 698 | 699 |
| ACCAAAAAC | 700 | 701 |
| CCCAAAAAC | 702 | 703 |
| AAACAAAAC | 704 | 705 |
| CAACAAAAC | 706 | 707 |
| ACACAAAAC | 708 | 709 |
| CCACAAAAC | 710 | 711 |
| AACCAAAAC | 712 | 713 |
| CACCAAAAC | 714 | 715 |
| ACCCAAAAC | 716 | 717 |
| CCCCAAAAC | 718 | 719 |
| AAAACAAAC | 720 | 721 |
| CAAACAAAC | 722 | 723 |
| ACAACAAAC | 724 | 725 |
| CCAACAAAC | 726 | 727 |
| AACACAAAC | 728 | 729 |
| CACACAAAC | 730 | 731 |
| ACCACAAAC | 732 | 733 |
| CCCACAAAC | 734 | 735 |
| AAACCAAAC | 736 | 737 |
| CAACCAAAC | 738 | 739 |
| ACACCAAAC | 740 | 741 |
| CCACCAAAC | 742 | 743 |
| AACCCAAAC | 744 | 745 |
| CACCCAAAC | 746 | 747 |
| ACCCCAAAC | 748 | 749 |
| CCCCCAAAC | 750 | 751 |
| AAAAACAAC | 752 | 753 |
| CAAAACAAC | 754 | 755 |
| ACAAACAAC | 756 | 757 |
| CCAAACAAC | 758 | 759 |
| AACAACAAC | 760 | 761 |
| CACAACAAC | 762 | 763 |
| ACCAACAAC | 764 | 765 |
| CCCAACAAC | 766 | 767 |
| AAACACAAC | 768 | 769 |
| CAACACAAC | 770 | 771 |
| ACACACAAC | 772 | 773 |
| CCACACAAC | 774 | 775 |
| AACCACAAC | 776 | 777 |
| CACCACAAC | 778 | 779 |
| ACCCACAAC | 780 | 781 |
| CCCCACAAC | 782 | 783 |
| AAAACCAAC | 784 | 785 |
| CAAACCAAC | 786 | 787 |
| ACAACCAAC | 788 | 789 |
| CCAACCAAC | 790 | 791 |
| AACACCAAC | 792 | 793 |
| CACACCAAC | 794 | 795 |
| ACCACCAAC | 796 | 797 |
| CCCACCAAC | 798 | 799 |
| AAACCCAAC | 800 | 801 |
| CAACCCAAC | 802 | 803 |
| ACACCCAAC | 804 | 805 |
| CCACCCAAC | 806 | 807 |
| AACCCCAAC | 808 | 809 |
| CACCCCAAC | 810 | 811 |
| ACCCCCAAC | 812 | 813 |
| CCCCCCAAC | 814 | 815 |
| AAAAAACAC | 816 | 817 |
| CAAAAACAC | 818 | 819 |
| ACAAAACAC | 820 | 821 |
| CCAAAACAC | 822 | 823 |
| AACAAACAC | 824 | 825 |
| CACAAACAC | 826 | 827 |
| ACCAAACAC | 828 | 829 |
| CCCAAACAC | 830 | 831 |
| AAACAACAC | 832 | 833 |
| CAACAACAC | 834 | 835 |
| ACACAACAC | 836 | 837 |
| CCACAACAC | 838 | 839 |
| AACCAACAC | 840 | 841 |
| CACCAACAC | 842 | 843 |
| ACCCAACAC | 844 | 845 |
| CCCCAACAC | 846 | 847 |

TABLE 2.5-continued

| VEGF-A/VEGF-C* Chimera | Predicted DNA Sequence Seq ID NO: | Predicted Protein Sequence Seq ID NO: |
|---|---|---|
| AAAACACAC | 848 | 849 |
| CAAACACAC | 850 | 851 |
| ACAACACAC | 852 | 853 |
| CCAACACAC | 854 | 855 |
| AACACACAC | 856 | 857 |
| CACACACAC | 858 | 859 |
| ACCACACAC | 860 | 861 |
| CCCACACAC | 862 | 863 |
| AAACCACAC | 864 | 865 |
| CAACCACAC | 866 | 867 |
| ACACCACAC | 868 | 869 |
| CCACCACAC | 870 | 871 |
| AACCCACAC | 872 | 873 |
| CACCCACAC | 874 | 875 |
| ACCCCACAC | 876 | 877 |
| CCCCCACAC | 878 | 879 |
| AAAAACCAC | 880 | 881 |
| CAAAACCAC | 882 | 883 |
| ACAAACCAC | 884 | 885 |
| CCAAACCAC | 886 | 887 |
| AACAACCAC | 888 | 889 |
| CACAACCAC | 890 | 891 |
| ACCAACCAC | 892 | 893 |
| CCCAACCAC | 894 | 895 |
| AAACACCAC | 896 | 897 |
| CAACACCAC | 898 | 899 |
| ACACACCAC | 900 | 901 |
| CCACACCAC | 902 | 903 |
| AACCACCAC | 904 | 905 |
| CACCACCAC | 906 | 907 |
| ACCCACCAC | 908 | 909 |
| CCCCACCAC | 910 | 911 |
| AAAACCCAC | 912 | 913 |
| CAAACCCAC | 914 | 915 |
| ACAACCCAC | 916 | 917 |
| CCAACCCAC | 918 | 919 |
| AACACCCAC | 920 | 921 |
| CACACCCAC | 922 | 923 |
| ACCACCCAC | 924 | 925 |
| CCCACCCAC | 926 | 927 |
| AAACCCCAC | 928 | 929 |
| CAACCCCAC | 930 | 931 |
| ACACCCCAC | 932 | 933 |
| CCACCCCAC | 934 | 935 |
| AACCCCCAC | 936 | 937 |
| CACCCCCAC | 938 | 939 |
| ACCCCCCAC | 940 | 941 |
| CCCCCCCAC | 942 | 943 |
| AAAAAAACC | 944 | 945 |
| CAAAAAACC | 946 | 947 |
| ACAAAAACC | 948 | 949 |
| CCAAAAACC | 950 | 951 |
| AACAAAACC | 952 | 953 |
| CACAAAACC | 954 | 955 |
| ACCAAAACC | 956 | 957 |
| CCCAAAACC | 958 | 959 |
| AAACAAACC | 960 | 961 |
| CAACAAACC | 962 | 963 |
| ACACAAACC | 964 | 965 |
| CCACAAACC | 966 | 967 |
| AACCAAACC | 968 | 969 |
| CACCAAACC | 970 | 971 |
| ACCCAAACC | 972 | 973 |
| CCCCAAACC | 974 | 975 |
| AAAACAACC | 976 | 977 |
| CAAACAACC | 978 | 979 |
| ACAACAACC | 980 | 981 |
| CCAACAACC | 982 | 983 |
| AACACAACC | 984 | 985 |
| CACACAACC | 986 | 987 |
| ACCACAACC | 988 | 989 |
| CCCACAACC | 990 | 991 |
| AAACCAACC | 992 | 993 |
| CAACCAACC | 994 | 995 |
| ACACCAACC | 996 | 997 |
| CCACCAACC | 998 | 999 |

TABLE 2.5-continued

| VEGF-A/VEGF-C* Chimera | Predicted DNA Sequence Seq ID NO: | Predicted Protein Sequence Seq ID NO: |
|---|---|---|
| AACCCAACC | 1000 | 1001 |
| CACCCAACC | 1002 | 1003 |
| ACCCCAACC | 1004 | 1005 |
| CCCCCAACC | 1006 | 1007 |
| AAAAACACC | 1008 | 1009 |
| CAAAACACC | 1010 | 1011 |
| ACAAACACC | 1012 | 1013 |
| CCAAACACC | 1014 | 1015 |
| AACAACACC | 1016 | 1017 |
| CACAACACC | 1018 | 1019 |
| ACCAACACC | 1020 | 1021 |
| CCCAACACC | 1022 | 1023 |
| AAACACACC | 1024 | 1025 |
| CAACACACC | 1026 | 1027 |
| ACACACACC | 1028 | 1029 |
| CCACACACC | 1030 | 1031 |
| AACCACACC | 1032 | 1033 |
| CACCACACC | 1034 | 1035 |
| ACCCACACC | 1036 | 1037 |
| CCCCACACC | 1038 | 1039 |
| AAAACCACC | 1040 | 1041 |
| CAAACCACC | 1042 | 1043 |
| ACAACCACC | 1044 | 1045 |
| CCAACCACC | 1046 | 1047 |
| AACACCACC | 1048 | 1049 |
| CACACCACC | 1050 | 1051 |
| ACCACCACC | 1052 | 1053 |
| CCCACCACC | 1054 | 1055 |
| AAACCCACC | 1056 | 1057 |
| CAACCCACC | 1058 | 1059 |
| ACACCCACC | 1060 | 1061 |
| CCACCCACC | 1062 | 1063 |
| AACCCCACC | 1064 | 1065 |
| CACCCCACC | 1066 | 1067 |
| ACCCCCACC | 1068 | 1069 |
| CCCCCCACC | 1070 | 1071 |
| AAAAAACCC | 1072 | 1073 |
| CAAAAACCC | 1074 | 1075 |
| ACAAAACCC | 1076 | 1077 |
| CCAAAACCC | 1078 | 1079 |
| AACAAACCC | 1080 | 1081 |
| CACAAACCC | 1082 | 1083 |
| ACCAAACCC | 1084 | 1085 |
| CCCAAACCC | 1086 | 1087 |
| AAACAACCC | 1088 | 1089 |
| CAACAACCC | 1090 | 1091 |
| ACACAACCC | 1092 | 1093 |
| CCACAACCC | 1094 | 1095 |
| AACCAACCC | 1096 | 1097 |
| CACCAACCC | 1098 | 1099 |
| ACCCAACCC | 1100 | 1101 |
| CCCCAACCC | 1102 | 1103 |
| AAAACACCC | 1104 | 1105 |
| CAAACACCC | 1106 | 1107 |
| ACAACACCC | 1108 | 1109 |
| CCAACACCC | 1110 | 1111 |
| AACACACCC | 1112 | 1113 |
| CACACACCC | 1114 | 1115 |
| ACCACACCC | 1116 | 1117 |
| CCCACACCC | 1118 | 1119 |
| AAACCACCC | 1120 | 1121 |
| CAACCACCC | 1122 | 1123 |
| ACACCACCC | 1124 | 1125 |
| CCACCACCC | 1126 | 1127 |
| AACCCACCC | 1128 | 1129 |
| CACCCACCC | 1130 | 1131 |
| ACCCCACCC | 1132 | 1133 |
| CCCCCACCC | 1134 | 1135 |
| AAAAACCCC | 1136 | 1137 |
| CAAAACCCC | 1138 | 1139 |
| ACAAACCCC | 1140 | 1141 |
| CCAAACCCC | 1142 | 1143 |
| AACAACCCC | 1144 | 1145 |
| CACAACCCC | 1146 | 1147 |
| ACCAACCCC | 1148 | 1149 |
| CCCAACCCC | 1150 | 1151 |

TABLE 2.5-continued

| VEGF-A/VEGF-C* Chimera | Predicted DNA Sequence Seq ID NO: | Predicted Protein Sequence Seq ID NO: |
|---|---|---|
| AAACACCCC | 1152 | 1153 |
| CAACACCCC | 1154 | 1155 |
| ACACACCCC | 1156 | 1157 |
| CCACACCCC | 1158 | 1159 |
| AACCACCCC | 1160 | 1161 |
| CACCACCCC | 1162 | 1163 |
| ACCCACCCC | 1164 | 1165 |
| CCCCACCCC | 1166 | 1167 |
| AAAACCCCC | 1168 | 1169 |
| CAAACCCCC | 1170 | 1171 |
| ACAACCCCC | 1172 | 1173 |
| CCAACCCCC | 1174 | 1175 |
| AACACCCCC | 1176 | 1177 |
| CACACCCCC | 1178 | 1179 |
| ACCACCCCC | 1180 | 1181 |
| CCCACCCCC | 1182 | 1183 |
| AAACCCCCC | 1184 | 1185 |
| CAACCCCCC | 1186 | 1187 |
| ACACCCCCC | 1188 | 1189 |
| CCACCCCCC | 1190 | 1191 |
| AACCCCCCC | 1192 | 1193 |
| CACCCCCCC | 1194 | 1195 |
| ACCCCCCCC | 1196 | 1197 |
| CCCCCCCCC | 1198 | 1199 |

*Construct nomenclature is identical to nomenclature of Table 3.

Assembly of the hybrid molecules can also be accomplished in fewer ligation steps than outlined above. For example, ligation of N123, N45, C67 and C89 can be completed in a single ligation reaction. By designing fragments with cohesive ends that are perfect complements only with cohesive ends of adjacent fragments, it is possible to ligate multiple fragments in a correct order in a single ligation reaction.

EXAMPLE 2

Expression of the Hybrid Molecules

Each of the 512 constructs were separately transfected transiently into 293T cells to express the different hybrid constructs. 293T cells were grown according to standard protocols in medium consisting of Dulbecco's modified Eagle's medium (D-MEM), and 10% fetal bovine serum (FBS). Twenty-four hours prior to transfection, confluent dishes were diluted 1:10 with fresh media into 6 wells. Four hours prior to transfection, the medium was changed. For each construct, 3 ug of DNA was transfected using standard protocols for calcium phosphate-mediated transfection [Sambrook et al., Molecular Cloning: A Laboratory Manual pp. 16.33-16.36 (1989)]. Twenty hours post-transfection, cells were washed twice with warm PBS and 2 ml of medium was added to each well.

Initial experiments were conducted to determine if the transfected cells were expressing the hybrid VEGF polypeptides encoded by the hybrid DNA molecules. Thus, 48 hours post-transfection, metabolic labeling with $^{35}$S-methionine and $^{35}$S-cysteine was initiated using 1.3 ml/well of labeling medium composed of MEM deficient for cysteine and methionine, 0.1% BSA, 24 μCi $^{35}$S-methionine-cysteine/ml (Redivue PRO-MIX, Amersham). The cell supernatant was harvested 72-78 hours post-transfection, cleared by centrifugation, and stored at 4° C.

The supernatant was immunoprecipitated with anti-pentahistidine antibody (Qiagen) by mixing 175 μl of sample supernatant with 100 μl IP mix (PBS with 1.5% BSA, 0.05%

Tween 20, and 12 μl/ml anti-pentahistidine antibody) at 4° C. overnight, with agitation. (The pSecTag I expression vector was engineered to express each of the hybrid VEGF proteins with a polyhistidine tag.) To collect immunoprecipitated protein, 50 μl of a 30% protein A sepharose (PAS, Pharmacia) slurry in PBS was added and incubated under agitation for at least 1.5 hr at 4° C. Standard buffer was added to each immunoprecipitation sample and boiled for 5 minutes at 95° C. during which the immunopreciptated proteins become dissociated from the protein A sepharose. After centrifugation, 10 μl of each sample was analyzed on 15% SDS-PAGE under reducing conditions. The gels were dried and exposed for either 12 hours on phosphorimager plates or 4 weeks on X-ray film. Results of these experiments are shown in Table 3 below, in the column marked "EXP" for expression. As shown in the table with "Yes", initial attempts to express the vast majority of the hybrid constructs were successful. Constructs for which weak ("weak"), and no expression ("none") were observed in preliminary studies also are indicated. The failure to achieve expression in initial studies is reported for completeness, and not intended to reflect a conclusion of non-viability or other identified problems. However, it is noteworthy that of the non-expressed constructs, almost all were those chimeric molecules in which fragment 3 was derived from VEGF-A and fragment 7 was derived from VEGF-C. Analysis of the physical relationship between these two fragments shows that residues from these two fragments barely contact each other at the atomic level as judged from the VEGF-A crystal structure. The incompatibility of fragment 3 from VEGF-A and fragment 7 from VEGF-C may arise from incorrect folding of the molecule, perhaps caused in part by rapid glycosylation of the VEGF-C-derived fragment 7 when the molecule appears in the endoplasmic reticulum. The glycosylation sites within VEGF-A are located at a distance from the receptor binding domain, whereas the glycosylation sites within VEGF-C are positioned closer towards the region of the molecule formed by fragment 3 that is predicted to form contacts with the third domain of the receptor. The carbohydrate residues may also be involved in the interaction between ligand and receptor.

EXAMPLE 3

Binding Assays of Hybrid Molecules to Soluble VEGF Receptor-Fc Fusion Proteins The hybrid proteins that were expressed in 293T cells (see Example 2 and Table 1) were tested for the ability to bind soluble VEGF receptor-Fc fusion proteins. Binding of the hybrid proteins to all three VEGF receptors, VEGFR-1, VEGFR-2, and VEGFR-3, was analyzed in this manner. Exemplary binding assays have been described in Achen et al., *Proc Natl Acad Sci USA* 95:548-53 (1998), incorporated by reference in its entirety.

It will be appreciated that binding assays can be performed with any form of naturally occurring VEGF receptors that retain the ability to bind their respective ligands, including but not limited to whole cells that naturally express a receptor or that have been recombinantly modified to express the receptor; truncated, solublized extracellular ligand binding domains of receptors; fusions comprising receptor extracellular domains fused to other proteins such as alkaline phosphatase (e.g., VEGFR-2-AP described in Cao et al., *J. Biol. Chem.* 271:3154-62 (1996)) or immunoglobulin sequences; and fusions comprising receptor extracellular domains fused to tag sequences (e.g., a polyhistidine tag) useful for capturing the protein with an antibody or with a solid support; and receptor extracellular domains chemically attached to solid supports such as CNBr-activated Sepharose beads.

For the present experiments, receptor binding was assayed using constructs comprising the extracellular domain of VEGFR-1, VEGFR-2, or VEGFR-3 fused to immunoglobulin constant region chains. The first three Ig domains of VEGFR-1 were fused to the Fc fragment from the Signal-pIgPlus vector (Ingenius/Novagen/R&D Systems). This construct (VEGFR-1-Fc) was stably expressed in Drosophila Schneider 2 (S2) cells, and purified using Protein A sepharose. Purity was analyzed by silver staining of a PAGE gel and the functionality of the fusion protein was tested by its ability to bind $^{35}$S-labeled VEGF protein. The VEGFR-2-Fc receptor comprises the first 3 Ig domains of VEGFR-2 (encoded by nucleotides 64-972 of GenBank Acc. No. X61656) fused to the Fc fragment in the pIg vector. The VEGFR-3-Fc receptor similarly consists if the first three Ig domains of VEGFR-3 (encoded by nucleotides 20-1005 of GenBank Acc. No. X68203) fused to the Fc fragment of the pIg vector. VEGFR-2-Fc and VEGFR-3-Fc proteins were expressed in 293T cells and purified as described above for VEGFR-1-Fc.

The binding assay procedure was identical to the immunoprecipitation using pentahistidine antibody described in Example 2, apart from the composition of the immunoprecipitation (IP) mixes. The IP mixes used for the receptor binding analysis were as follows: For VEGFR-1 binding assays, the IP mix was phosphate buffered saline (PBS) containing 1.5% BSA, 0.06% Tween 20, 3 μg/ml heparin and 400 ng/ml VEGFR-1-Fc fusion protein (100 μl of this IP mix was added to 200 μl of sample supernatant); for VEGFR-2 binding assays, the IP mix was 82% conditioned cell supernatant from 293T cells transiently expressing VEGFR-2-Fc fusion protein in mixture with 18% of a PBS solution that contained 5% BSA, 0.2% Tween 20, and 10 μg/ml heparin (250 μl of IP mix was added to 200 μl of sample supernatant); and for VEGFR-3 binding assays, the IP mix was 82% conditioned cell supernatant from 293T cells transiently expressing VEGFR-3-Fc fusion protein, 18% of PBS containing 5% BSA, 0.2% Tween 20, and 10 μg/ml heparin (250 μl of IP mix was added to 200 μl of sample supernatant). A few selected constructs (clones 12-1, 12-5, 12-7, 12-9, 12-11, 12-13, 12-14, 14-9, 23-1, 32-14, 52-15, 53-3, 82-7, 82-9, 82-11, 82-13, 83-15, 84-9, and 84-11) were examined more than one time.

Results from the binding assays using $^{35}$S labeled hybrid proteins are summarized in Table 3 below. The apparent molecular weights of the detected proteins were between 18 and 27 kD. Usually two bands were visible with different band intensities. Sometimes, the second band was only detectable after long exposures. The presence of two bands correlates with the origin of fragment 7 and 9 of the hybrid protein being examined. Fragment 7 contains a potential N-glycosylation site irrespective of whether it was derived from VEGF-A or VEGF-C, whereas fragment 9 only contains an N-glycosylation site if it originated from VEGF-C. Thus, the multiple bands are likely due to differential glycosylation of the hybrid protein being analyzed. The following are predicted bands for different combinations of glycosylation sites:

(1) fragment 7 derived from VEGF-A and fragment 9 from VEGF-A produces two bands of ~18 and ~22 kD (2) fragment 7 derived from VEGF-A and fragment 9 from VEGF-C produces an ~26 kD band (a second band of ~22 kD is sometimes missing, a third extremely weak band of ~18 kD is sometimes visible)

(3) fragment 7 derived from VEGF-C and fragment 9 from VEGF-A produces an ~22 kD band (a second band of ~18 kD is sometimes missing)

(4) fragment 7 derived from VEGF-C and fragment 9 from VEGF-C produces one band of ~23 kD.

Results of the binding assays indicate that if both glycosylation sites were derived from VEGF-C, less heterogeneous glycosylation is observed. Molecules containing both fragment 7 from VEGF-A and fragment 9 from VEGF-C appear to promote artificial hyperglycosylation. The VEGF-A glycosylation site contained in fragment 7 is also prone to incomplete glycosylation The binding assay data indicate that several of the hybrid molecules exhibit novel binding properties. Although the analysis was not quantitative, some of the hybrid molecules show different relative signal strengths. For example, clone 72-10 appears to have lost much of its affinity for VEGFR-3 while retaining most of its affinity for VEGFR-2. These results suggest that among the hybrid proteins that retained the receptor specificities of either parent protein (VEGF-A or VEGF-C), some may have undergone differential changes in their binding affinities towards the corresponding receptors.

In Table 3 below, column 1 lists the names of the constructs examined. Column 2 sequentially lists the 9 fragments of each construct, where A=fragment from VEGF-A, and C=fragment from VEGF-C. Column 3 labeled "EXP" lists the results from the experiments to express the constructs in 293T cells, as described in Example 2. In this column, "none" indicates that no detectable protein was expressed; "weak" indicates that weak expression was detectable; and "yes" indicates that the expressed protein was readily detectable. The final three columns list results from the receptor binding assays described in Example 3, where binding to VEGFR-1-Fc; VEGFR-2-Fc; and VEGFR-3-Fc were examined. For these last three columns, "yes" indicates binding, "none" indicates no detectable binding to the receptor, and "0" indicates that this construct was not expressed in 293T cells, thus, could not be used for binding assays.

TABLE 3

Results of hybrid molecule expression and receptor binding analysis

| | | EXP | VEGFR-1 | VEGFR-2 | VEGFR-3 |
|---|---|---|---|---|---|
| 31-1 | A C A A A A A A A | yes | none | none | none |
| 31-5 | A C A A A A C A A | none | 0 | 0 | 0 |
| 31-13 | A C A A A C C A A | none | 0 | 0 | 0 |
| 31-9 | A C A A A C A A A | yes | none | none | none |
| 31-2 | A C A A A A A A C | yes | none | none | none |
| 31-10 | A C A A A C A A C | yes | none | none | none |
| 31-6 | A C A A A A C A C | yes | none | none | none |
| 31-14 | A C A A A C C A C | none | 0 | 0 | 0 |
| 31-12 | A C A A A C A C A | yes | none | none | none |
| 31-11 | A C A A A C A C A | yes | none | none | none |
| 31-7 | A C A A A A C C A | none | 0 | 0 | 0 |
| 31-4 | A C A A A A A C C | yes | none | none | none |
| 31-8 | A C A A A A C C C | yes | 0 | 0 | 0 |
| 31-3 | A C A A A A A C A | yes | none | none | none |
| 31-15 | A C A A A C C C A | none | 0 | 0 | 0 |
| 31-16 | A C A A A C C C C | none | 0 | 0 | 0 |
| 21-1 | C C C A A A A A A | yes | none | none | none |
| 21-2 | C C C A A A C A A | yes | none | none | none |
| 21-3 | C C C A A C A A A | yes | none | none | none |
| 21-4 | C C C A A C C A A | yes | none | none | none |
| 21-5 | C C C A A A A A C | yes | none | none | none |
| 21-6 | C C C A A A C A C | yes | none | none | none |

TABLE 3-continued

Results of hybrid molecule expression and receptor binding analysis

| | | EXP | VEGFR-1 | VEGFR-2 | VEGFR-3 |
|---|---|---|---|---|---|
| 21-7 | C C C A A C A A C | yes | none | none | none |
| 21-8 | C C C A A C C A C | yes | none | none | none |
| 21-9 | C C C A A A A C A | yes | none | none | none |
| 21-10 | C C C A A A C C A | yes | none | none | none |
| 21-11 | C C C A A C A C A | yes | none | none | none |
| 21-12 | C C C A A C C C A | yes | none | none | none |
| 21-13 | C C C A A A A C C | yes | none | none | none |
| 21-14 | C C C A A A C C C | yes | none | none | none |
| 21-15 | C C C A A C A C C | yes | none | none | none |
| 21-16 | C C C A A C C C C | yes | none | none | none |
| 22-1 | C C C C C A A A A | yes | none | none | none |
| 22-2 | C C C C C A C A A | yes | none | yes | yes |
| 22-3 | C C C C C C A A A | yes | none | none | yes |
| 22-4 | C C C C C C C A A | yes | none | yes | yes |
| 22-5 | C C C C C A A A C | yes | none | none | none |
| 22-6 | C C C C C A C A C | yes | none | yes | yes |
| 22-7 | C C C C C C A A C | yes | none | none | none |
| 22-8 | C C C C C C C A C | yes | none | yes | yes |
| 22-9 | C C C C C A A C A | yes | none | none | none |
| 22-10 | C C C C C A C C A | yes | none | yes | yes |
| 22-11 | C C C C C C A C A | yes | none | none | none |
| 22-12 | C C C C C C C C A | yes | none | yes | yes |
| 22-13 | C C C C C A A C C | yes | none | none | none |
| 22-14 | C C C C C A C C C | yes | none | yes | yes |
| 22-15 | C C C C C C A C C | yes | none | none | none |
| 22-16 | C C C C C C C C C | yes | none | yes | yes |
| 72-1 | A C C C C A A A A | yes | none | none | none |
| 72-2 | A C C C C A C A A | yes | none | yes | yes |
| 72-3 | A C C C C C A A A | yes | none | none | none |
| 72-4 | A C C C C C C A A | yes | none | yes | yes |
| 72-5 | A C C C C A A A C | yes | none | none | none |
| 72-6 | A C C C C A C A C | yes | none | none | yes |
| 72-7 | A C C C C C A A C | yes | none | none | none |
| 72-8 | A C C C C C C A C | yes | none | yes | yes |
| 72-9 | A C C C C A A C A | yes | none | none | none |
| 72-10 | A C C C C A C C A | yes | none | yes | yes |
| 72-11 | A C C C C C A C A | yes | none | none | none |
| 72-12 | A C C C C C C C A | yes | none | yes | yes |
| 72-13 | A C C C C A A C C | yes | none | none | none |
| 72-14 | A C C C C A C C C | yes | none | yes | yes |
| 72-15 | A C C C C C A C C | yes | none | none | none |
| 72-16 | A C C C C C C C C | yes | none | yes | yes |
| 11-1 | A A A A A A A A A | yes | yes | yes | none |
| 11-2 | A A A A A A C A A | none | 0 | 0 | 0 |
| 11-3 | A A A A A C A A A | yes | yes | yes | none |
| 11-4 | A A A A A C C A A | none | 0 | 0 | 0 |
| 11-5 | A A A A A A A A C | yes | yes | yes | none |
| 11-6 | A A A A A A C A C | none | 0 | 0 | 0 |
| 11-7 | A A A A A C A A C | yes | yes | yes | none |
| 11-8 | A A A A A C C A C | none | 0 | 0 | 0 |
| 11-9 | A A A A A A A C A | yes | yes | none | none |
| 11-10 | A A A A A A C C A | none | 0 | 0 | 0 |
| 11-11 | A A A A A C A C A | yes | yes | yes | none |
| 11-12 | A A A A A C C C A | none | 0 | 0 | 0 |
| 11-13 | A A A A A A A C C | yes | yes | none | none |
| 11-14 | A A A A A A C C C | none | 0 | 0 | 0 |
| 11-15 | A A A A A C A C C | yes | yes | yes | none |
| 11-16 | A A A A A C C C C | none | 0 | 0 | 0 |
| 12-1 | A A A C C A A A A | yes | yes | yes | yes |
| 12-2 | A A A C C A C A A | none | 0 | 0 | 0 |
| 12-3 | A A A C C C A A A | yes | yes | yes | none |
| 12-4 | A A A C C C C A A | none | 0 | 0 | 0 |
| 12-5 | A A A C C A A A C | yes | yes | none | none |
| 12-6 | A A A C C A C A C | none | 0 | 0 | 0 |
| 12-7 | A A A C C C A A C | yes | yes | yes | yes |
| 12-8 | A A A C C C C A C | none | 0 | 0 | 0 |
| 12-9 | A A A C C A A C A | yes | yes | none | yes |
| 12-10 | A A A C C A C C A | none | 0 | 0 | 0 |
| 12-11 | A A A C C C A C A | yes | yes | yes | yes |
| 12-12 | A A A C C C C C A | none | 0 | 0 | 0 |
| 12-13 | A A A C C A A C C | yes | yes | none | yes |
| 12-14 | A A A C C A C C C | yes | none | none | yes |
| 12-15 | A A A C C C A C C | yes | none | yes | yes |
| 12-16 | A A A C C C C C C | yes | none | none | yes |
| 81-1 | C A A A A A A A A | yes | yes | yes | none |

TABLE 3-continued

Results of hybrid molecule expression and receptor binding analysis

| | | EXP | VEGFR-1 | VEGFR-2 | VEGFR-3 |
|---|---|---|---|---|---|
| 81-2 | C A A A A A C A A | none | 0 | 0 | 0 |
| 81-3 | C A A A A C A A A | yes | yes | yes | none |
| 81-4 | C A A A A C C A A | none | 0 | 0 | 0 |
| 81-5 | C A A A A A A A C | yes | yes | yes | none |
| 81-6 | C A A A A A C A C | none | 0 | 0 | 0 |
| 81-7 | C A A A A C A A C | yes | yes | yes | none |
| 81-8 | C A A A A C C A C | none | 0 | 0 | 0 |
| 81-9 | C A A A A A A C A | yes | yes | none | none |
| 81-10 | C A A A A A C C A | none | 0 | 0 | 0 |
| 81-11 | C A A A A C A C A | yes | yes | yes | none |
| 81-12 | C A A A A C C C A | none | 0 | 0 | 0 |
| 81-13 | C A A A A A A C C | yes | yes | none | none |
| 81-14 | C A A A A A C C C | none | 0 | 0 | 0 |
| 81-15 | C A A A A C A C C | yes | yes | yes | none |
| 81-16 | C A A A A C C C C | none | 0 | 0 | 0 |
| 13-1 | A A A A C A A A A | yes | yes | yes | none |
| 13-2 | A A A A C A C A A | none | 0 | 0 | 0 |
| 13-3 | A A A A C C A A A | none | 0 | 0 | 0 |
| 13-4 | A A A A C C C A A | yes | none | none | none |
| 13-5 | A A A A C A A A C | yes | yes | yes | none |
| 13-6 | A A A A C A C A C | yes | none | none | none |
| 13-7 | A A A A C C A A C | yes | yes | yes | none |
| 13-8 | A A A A C C C A C | yes | none | none | none |
| 13-9 | A A A A C A A C A | yes | yes | none | none |
| 13-10 | A A A A C A C C A | none | 0 | 0 | 0 |
| 13-11 | A A A A C C A C A | yes | yes | none | none |
| 13-12 | A A A A C C C C A | none | 0 | 0 | 0 |
| 13-13 | A A A A C A A C C | yes | yes | none | none |
| 13-14 | A A A A C A C C C | yes | none | none | none |
| 13-15 | A A A A C C A C C | yes | yes | none | none |
| 13-16 | A A A A C C C C C | none | 0 | 0 | 0 |
| 14-1 | A A A C A A A A A | yes | yes | none | none |
| 14-2 | A A A C A A C A A | none | 0 | 0 | 0 |
| 14-3 | A A A C A C A A A | yes | yes | yes | none |
| 14-4 | A A A C A C C A A | none | 0 | 0 | 0 |
| 14-5 | A A A C A A A A C | yes | yes | none | none |
| 14-6 | A A A C A A C A C | none | 0 | 0 | 0 |
| 14-7 | A A A C A C A A C | yes | none | yes | none |
| 14-8 | A A A C A C C A C | none | 0 | 0 | 0 |
| 14-9 | A A A C A A A C A | yes | yes | yes | yes |
| 14-10 | A A A C A A C C A | none | 0 | 0 | 0 |
| 14-11 | A A A C A C A C A | none | 0 | 0 | 0 |
| 14-12 | A A A C A C C C A | none | 0 | 0 | 0 |
| 14-13 | A A A C A A A C C | yes | none | none | none |
| 14-14 | A A A C A A C C C | none | 0 | 0 | 0 |
| 14-15 | A A A C A C A C C | yes | none | none | none |
| 14-16 | A A A C A C C C C | none | 0 | 0 | 0 |
| 23-1 | C C C A C A A A A | yes | none | none | none |
| 23-2 | C C C A C A C A A | yes | none | none | none |
| 23-3 | C C C A C C A A A | yes | none | none | none |
| 23-4 | C C C A C C C A A | yes | none | none | none |
| 23-5 | C C C A C A A A C | yes | none | none | none |
| 23-6 | C C C A C A C A C | yes | none | none | none |
| 23-7 | C C C A C C A A C | yes | none | none | none |
| 23-8 | C C C A C C C A C | yes | none | none | none |
| 23-9 | C C C A C A A C A | yes | none | none | none |
| 23-10 | C C C A C A C C A | yes | none | yes | none |
| 23-11 | C C C A C C A C A | yes | none | none | none |
| 23-12 | C C C A C C C C A | yes | none | yes | none |
| 23-13 | C C C A C A A C C | yes | none | none | none |
| 23-14 | C C C A C A C C C | yes | none | yes | none |
| 23-15 | C C C A C C A C C | yes | none | none | none |
| 23-16 | C C C A C C C C C | yes | none | none | none |
| 33-1 | A C A A C A A A A | yes | none | yes | none |
| 33-2 | A C A A C A C A A | yes | none | none | none |
| 33-3 | A C A A C C A A A | yes | none | yes | none |
| 33-4 | A C A A C C C A A | yes | none | none | none |
| 33-5 | A C A A C A A A C | yes | none | none | none |
| 33-6 | A C A A C A C A C | yes | none | none | none |
| 33-7 | A C A A C C A A C | yes | none | none | none |
| 33-8 | A C A A C C C A C | yes | none | none | none |
| 33-9 | A C A A C A A C A | yes | none | yes | none |
| 33-10 | A C A A C A C C A | none | 0 | 0 | 0 |
| 33-11 | A C A A C C A C A | yes | none | none | none |
| 33-12 | A C A A C C C C A | none | 0 | 0 | 0 |
| 33-13 | A C A A C A A C C | yes | none | none | none |
| 33-14 | A C A A C A C C C | yes | none | none | none |
| 33-15 | A C A A C C A C C | yes | none | none | none |
| 33-16 | A C A A C C C C C | yes | none | none | none |
| 34-1 | A C A C A A A A A | yes | none | none | none |
| 34-2 | A C A C A A C A A | none | 0 | 0 | 0 |
| 34-3 | A C A C A C A A A | yes | none | none | none |
| 34-4 | A C A C A C C A A | none | 0 | 0 | 0 |
| 34-5 | A C A C A A A A C | yes | none | none | none |
| 34-6 | A C A C A A C A C | none | 0 | 0 | 0 |
| 34-7 | A C A C A C A A C | yes | none | none | none |
| 34-8 | A C A C A C C A C | none | 0 | 0 | 0 |
| 34-9 | A C A C A A A C A | yes | none | none | none |
| 34-10 | A C A C A A C C A | none | 0 | 0 | 0 |
| 34-11 | A C A C A C A C A | yes | none | none | none |
| 34-12 | A C A C A C C C A | none | 0 | 0 | 0 |
| 34-13 | A C A C A A A C C | yes | none | none | none |
| 34-14 | A C A C A A C C C | yes | none | none | none |
| 34-15 | A C A C A C A C C | yes | none | none | none |
| 34-16 | A C A C A C C C C | none | 0 | 0 | 0 |
| 41-1 | C A C A A A A A A | yes | yes | none | none |
| 41-2 | C A C A A A C A A | none | 0 | 0 | 0 |
| 41-3 | C A C A A C A A A | yes | none | none | none |
| 41-4 | C A C A A C C A A | none | 0 | 0 | 0 |
| 41-5 | C A C A A A A A C | yes | none | none | none |
| 41-6 | C A C A A A C A C | yes | none | none | none |
| 41-7 | C A C A A C A A C | yes | none | none | none |
| 41-8 | C A C A A C C A C | none | 0 | 0 | 0 |
| 41-9 | C A C A A A A C A | yes | none | none | none |
| 41-10 | C A C A A A C C A | none | 0 | 0 | 0 |
| 41-11 | C A C A A C A C A | yes | none | none | none |
| 41-12 | C A C A A C C C A | none | 0 | 0 | 0 |
| 41-13 | C A C A A A A C C | yes | none | none | none |
| 41-14 | C A C A A A C C C | yes | none | none | none |
| 41-15 | C A C A A C A C C | yes | none | none | none |
| 41-16 | C A C A A C C C C | yes | none | none | none |
| 42-1 | C A C C C A A A A | yes | none | none | none |
| 42-2 | C A C C C A C A A | none | 0 | 0 | 0 |
| 42-3 | C A C C C C A A A | yes | none | none | none |
| 42-4 | C A C C C C C A A | none | 0 | 0 | 0 |
| 42-5 | C A C C C A A A C | none | 0 | 0 | 0 |
| 42-6 | C A C C C A C A C | yes | none | none | none |
| 42-7 | C A C C C C A A C | yes | none | none | none |
| 42-8 | C A C C C C C A C | yes | none | none | none |
| 42-9 | C A C C C A A C A | yes | none | none | none |
| 42-10 | C A C C C A C C A | yes | none | none | none |
| 42-11 | C A C C C C A C A | yes | none | none | none |
| 42-12 | C A C C C C C C A | yes | none | none | none |
| 42-13 | C A C C C A A C C | yes | none | none | none |
| 42-14 | C A C C C A C C C | yes | none | none | none |
| 42-15 | C A C C C C A C C | yes | none | none | none |
| 42-16 | C A C C C C C C C | yes | none | none | none |
| 43-1 | C A C A C A A A A | yes | yes | none | none |
| 43-2 | C A C A C A C A A | none | 0 | 0 | 0 |
| 43-3 | C A C A C C A A A | yes | none | none | none |
| 43-4 | C A C A C C C A A | none | 0 | 0 | 0 |
| 43-5 | C A C A C A A A C | yes | none | none | none |
| 43-6 | C A C A C A C A C | yes | none | none | none |
| 43-7 | C A C A C C A A C | yes | none | none | none |
| 43-8 | C A C A C C C A C | yes | none | none | none |
| 43-9 | C A C A C A A C A | yes | none | none | none |
| 43-10 | C A C A C A C C A | none | 0 | 0 | 0 |
| 43-11 | C A C A C C A C A | yes | none | none | none |
| 43-12 | C A C A C C C C A | none | 0 | 0 | 0 |
| 43-13 | C A C A C A A C C | yes | none | none | none |
| 43-14 | C A C A C A C C C | yes | none | none | none |
| 43-15 | C A C A C C A C C | yes | none | none | none |
| 43-16 | C A C A C C C C C | yes | none | none | none |
| 44-1 | C A C C A A A A A | yes | none | none | none |
| 44-2 | C A C C A A C A A | yes | none | none | none |
| 44-3 | C A C C A C A A A | yes | none | none | none |
| 44-4 | C A C C A C C A A | yes | none | none | none |
| 44-5 | C A C C A A A A C | yes | none | none | none |
| 44-6 | C A C C A A C A C | none | 0 | 0 | 0 |
| 44-7 | C A C C A C A A C | yes | none | none | none |

TABLE 3-continued

Results of hybrid molecule expression and receptor binding analysis

| | | EXP | VEGFR-1 | VEGFR-2 | VEGFR-3 |
|---|---|---|---|---|---|
| 44-8 | C A C C A C C A C | yes | none | none | none |
| 44-9 | C A C C A A A C A | yes | none | none | none |
| 44-10 | C A C C A A C C A | yes | none | none | none |
| 44-11 | C A C C A C A C A | yes | none | none | none |
| 44-12 | C A C C A C C C A | yes | none | none | none |
| 44-13 | C A C C A A A C C | yes | none | none | none |
| 44-14 | C A C C A A C C C | yes | none | none | none |
| 44-15 | C A C C A C A C C | yes | none | none | none |
| 44-16 | C A C C A C C C C | yes | none | none | none |
| 54-1 | C C A C A A A A A | yes | none | none | none |
| 54-2 | C C A C A A C A A | none | 0 | 0 | 0 |
| 54-3 | C C A C A C A A A | yes | none | none | none |
| 54-4 | C C A C A C C A A | none | 0 | 0 | 0 |
| 54-5 | C C A C A A A A C | yes | none | none | none |
| 54-6 | C C A C A A C A C | none | 0 | 0 | 0 |
| 54-7 | C C A C A C A A C | yes | none | none | none |
| 54-8 | C C A C A C C A C | none | 0 | 0 | 0 |
| 54-9 | C C A C A A A C A | yes | none | none | none |
| 54-10 | C C A C A A C C A | yes | none | none | none |
| 54-11 | C C A C A C A C A | yes | none | none | none |
| 54-12 | C C A C A C C C A | none | 0 | 0 | 0 |
| 54-13 | C C A C A A A C C | yes | none | none | none |
| 54-14 | C C A C A A C C C | none | 0 | 0 | 0 |
| 54-15 | C C A C A C A C C | yes | none | none | none |
| 54-16 | C C A C A C C C C | none | 0 | 0 | 0 |
| 64-1 | A A C C A A A A A | yes | none | none | none |
| 64-2 | A A C C A A C A A | yes | none | none | none |
| 64-3 | A A C C A C A A A | yes | none | none | none |
| 64-4 | A A C C A C C A A | yes | none | none | none |
| 64-5 | A A C C A A A A C | yes | none | none | none |
| 64-6 | A A C C A A C A C | yes | none | none | none |
| 64-7 | A A C C A C A A C | yes | none | none | none |
| 64-8 | A A C C A C C A C | yes | none | none | none |
| 64-9 | A A C C A A A C A | yes | none | none | none |
| 64-10 | A A C C A A C C A | yes | none | none | none |
| 64-11 | A A C C A C A C A | yes | none | none | none |
| 64-12 | A A C C A C C C A | yes | none | none | none |
| 64-13 | A A C C A A A C C | yes | none | none | none |
| 64-14 | A A C C A A C C C | yes | none | none | none |
| 64-15 | A A C C A C A C C | yes | none | none | none |
| 64-16 | A A C C A C C C C | yes | none | none | none |
| 83-1 | C A A A C A A A A | yes | yes | yes | none |
| 83-2 | C A A A C A C A A | none | 0 | 0 | 0 |
| 83-3 | C A A A C C A A A | yes | yes | yes | none |
| 83-4 | C A A A C C C A A | none | 0 | 0 | 0 |
| 83-5 | C A A A C A A A C | yes | yes | yes | none |
| 83-6 | C A A A C A C A C | yes | none | none | none |
| 83-7 | C A A A C C A A C | yes | yes | yes | none |
| 83-8 | C A A A C C C A C | none | 0 | 0 | 0 |
| 83-9 | C A A A C A A C A | yes | yes | none | none |
| 83-10 | C A A A C A C C A | none | 0 | 0 | 0 |
| 83-11 | C A A A C C A C A | yes | yes | yes | none |
| 83-12 | C A A A C C C C A | none | 0 | 0 | 0 |
| 83-13 | C A A A C A A C C | yes | yes | none | none |
| 83-14 | C A A A C A C C C | none | 0 | 0 | 0 |
| 83-15 | C A A A C C A C C | yes | yes | yes | none |
| 83-16 | C A A A C C C C C | none | 0 | 0 | 0 |
| 24-1 | C C C C A A A A A | yes | none | none | none |
| 24-2 | C C C C A A C A A | yes | none | none | none |
| 24-3 | C C C C A C A A A | yes | none | none | none |
| 24-4 | C C C C A C C A A | yes | none | none | none |
| 24-5 | C C C C A A A A C | yes | none | none | none |
| 24-6 | C C C C A A C A C | yes | none | none | none |
| 24-7 | C C C C A C A A C | yes | none | none | none |
| 24-8 | C C C C A C C A C | yes | none | none | none |
| 24-9 | C C C C A A A C A | yes | none | none | none |
| 24-10 | C C C C A A C C A | yes | none | none | none |
| 24-11 | C C C C A C A C A | yes | none | none | none |
| 24-12 | C C C C A C C C A | yes | none | none | none |
| 24-13 | C C C C A A A C C | yes | none | none | none |
| 24-14 | C C C C A A C C C | yes | none | none | none |
| 24-15 | C C C C A C A C C | yes | none | none | none |
| 24-16 | C C C C A C C C C | yes | none | none | none |
| 32-1 | A C A C C A A A A | yes | none | none | none |
| 32-2 | A C A C C A C A A | none | 0 | 0 | 0 |

TABLE 3-continued

Results of hybrid molecule expression and receptor binding analysis

| | | EXP | VEGFR-1 | VEGFR-2 | VEGFR-3 |
|---|---|---|---|---|---|
| 32-3 | A C A C C C A A A | yes | none | none | none |
| 32-4 | A C A C C C C A A | none | 0 | 0 | 0 |
| 32-5 | A C A C C A A A C | yes | none | none | none |
| 32-6 | A C A C C A C A C | yes | none | none | none |
| 32-7 | A C A C C C A A C | yes | none | none | none |
| 32-8 | A C A C C C C A C | yes | none | none | none |
| 32-9 | A C A C C A A C A | yes | none | none | yes |
| 32-10 | A C A C C A C C A | none | 0 | 0 | 0 |
| 32-11 | A C A C C C A C A | yes | none | none | yes |
| 32-12 | A C A C C C C C A | none | 0 | 0 | 0 |
| 32-13 | A C A C C A A C C | yes | none | none | none |
| 32-14 | A C A C C A C C C | yes | none | none | yes |
| 32-15 | A C A C C C A C C | yes | none | none | yes |
| 32-16 | A C A C C C C C C | yes | none | none | yes |
| 51-1 | C C A A A A A A A | yes | none | none | none |
| 51-2 | C C A A A A C A A | yes | none | none | none |
| 51-3 | C C A A A C A A A | yes | none | none | none |
| 51-4 | C C A A A C C A A | yes | none | none | none |
| 51-5 | C C A A A A A A C | yes | none | none | none |
| 51-6 | C C A A A A C A C | yes | none | none | none |
| 51-7 | C C A A A C A A C | yes | none | none | none |
| 51-8 | C C A A A C C A C | yes | none | none | none |
| 51-9 | C C A A A A A C A | yes | none | none | none |
| 51-10 | C C A A A A C C A | none | 0 | 0 | 0 |
| 51-11 | C C A A A C A C A | yes | none | none | none |
| 51-12 | C C A A A C C C A | none | 0 | 0 | 0 |
| 51-13 | C C A A A A A C C | yes | none | none | none |
| 51-14 | C C A A A A C C C | yes | none | none | none |
| 51-15 | C C A A A C A C C | yes | none | none | none |
| 51-16 | C C A A A C C C C | none | 0 | 0 | 0 |
| 52-1 | C C A C C A A A A | yes | none | none | none |
| 52-2 | C C A C C A C A A | none | 0 | 0 | 0 |
| 52-3 | C C A C C C A A A | yes | none | none | none |
| 52-4 | C C A C C C C A A | none | 0 | 0 | 0 |
| 52-5 | C C A C C A A A C | yes | none | none | none |
| 52-6 | C C A C C A C A C | yes | none | none | none |
| 52-7 | C C A C C C A A C | yes | none | none | none |
| 52-8 | C C A C C C C A C | yes | none | none | none |
| 52-9 | C C A C C A A C A | yes | none | none | yes |
| 52-10 | C C A C C A C C A | none | 0 | 0 | 0 |
| 52-11 | C C A C C C A C A | yes | none | none | yes |
| 52-12 | C C A C C C C C A | none | 0 | 0 | 0 |
| 52-13 | C C A C C A A C C | none | 0 | 0 | 0 |
| 52-14 | C C A C C A C C C | yes | none | none | yes |
| 52-15 | C C A C C C A C C | yes | none | none | yes |
| 52-16 | C C A C C C C C C | yes | none | yes | yes |
| 53-1 | C C A A C A A A A | yes | none | yes | none |
| 53-2 | C C A A C A C A A | none | 0 | 0 | 0 |
| 53-3 | C C A A C C A A A | yes | yes | yes | yes |
| 53-4 | C C A A C C C A A | none | 0 | 0 | 0 |
| 53-5 | C C A A C A A A C | yes | none | none | none |
| 53-6 | C C A A C A C A C | yes | none | none | none |
| 53-7 | C C A A C C A A C | yes | none | yes | none |
| 53-8 | C C A A C C C A C | yes | none | none | none |
| 53-9 | C C A A C A A C A | yes | none | none | none |
| 53-10 | C C A A C A C C A | none | 0 | 0 | 0 |
| 53-11 | C C A A C C A C A | yes | none | none | none |
| 53-12 | C C A A C C C C A | none | 0 | 0 | 0 |
| 53-13 | C C A A C A A C C | yes | none | none | none |
| 53-14 | C C A A C A C C C | yes | none | none | none |
| 53-15 | C C A A C C A C C | yes | none | none | none |
| 53-16 | C C A A C C C C C | yes | none | none | none |
| 61-1 | A A C A A A A A A | yes | yes | none | none |
| 61-2 | A A C A A A C A A | yes | none | none | none |
| 61-3 | A A C A A C A A A | yes | yes | none | none |
| 61-4 | A A C A A C C A A | yes | none | none | none |
| 61-5 | A A C A A A A A C | yes | none | none | none |
| 61-6 | A A C A A A C A C | yes | none | none | none |
| 61-7 | A A C A A C A A C | yes | none | none | none |
| 61-8 | A A C A A C C A C | yes | none | none | none |
| 61-9 | A A C A A A A C A | yes | none | none | none |
| 61-10 | A A C A A A C C A | yes | none | none | none |
| 61-11 | A A C A A C A C A | yes | none | none | none |
| 61-12 | A A C A A C C C A | yes | none | none | none |
| 61-13 | A A C A A A A C C | yes | none | none | none |

TABLE 3-continued

Results of hybrid molecule expression and receptor binding analysis

| | | EXP | VEGFR-1 | VEGFR-2 | VEGFR-3 |
|---|---|---|---|---|---|
| 61-14 | A A C A A A C C C | yes | none | none | none |
| 61-15 | A A C A A C A C C | yes | none | none | none |
| 61-16 | A A C A A C C C C | yes | none | none | none |
| 62-1 | A A C C C A A A A | yes | yes | none | none |
| 62-2 | A A C C C A C A A | yes | 0 | 0 | 0 |
| 62-3 | A A C C C C A A A | yes | none | none | none |
| 62-4 | A A C C C C C A A | yes | none | none | none |
| 62-5 | A A C C C A A A C | yes | none | none | none |
| 62-6 | A A C C C A C A C | yes | none | none | none |
| 62-7 | A A C C C C A A C | yes | none | none | none |
| 62-8 | A A C C C C C A C | yes | none | yes | none |
| 62-9 | A A C C C A A C A | yes | none | none | none |
| 62-10 | A A C C C A C C A | yes | none | yes | none |
| 62-11 | A A C C C C A C A | yes | none | yes | yes |
| 62-12 | A A C C C C C C A | yes | none | none | none |
| 62-13 | A A C C C A A C C | yes | none | yes | none |
| 62-14 | A A C C C A C C C | yes | none | none | none |
| 62-15 | A A C C C C A C C | yes | none | none | none |
| 62-16 | A A C C C C C C C | yes | none | none | none |
| 63-1 | A A C A C A A A A | yes | yes | yes | none |
| 63-2 | A A C A C A C A A | none | 0 | 0 | 0 |
| 63-3 | A A C A C C A A A | yes | none | yes | none |
| 63-4 | A A C A C C C A A | none | 0 | 0 | 0 |
| 63-5 | A A C A C A A A C | yes | none | none | none |
| 63-6 | A A C A C A C A C | yes | none | yes | none |
| 63-7 | A A C A C C A A C | yes | none | yes | yes |
| 63-8 | A A C A C C C A C | yes | none | none | none |
| 63-9 | A A C A C A A C A | yes | none | none | none |
| 63-10 | A A C A C A C C A | yes | none | none | none |
| 63-11 | A A C A C C A C A | yes | none | none | none |
| 63-12 | A A C A C C C C A | yes | 0 | 0 | 0 |
| 63-13 | A A C A C A A C C | yes | none | none | none |
| 63-14 | A A C A C A C C C | yes | none | none | none |
| 63-15 | A A C A C C A C C | yes | none | none | none |
| 63-16 | A A C A C C C C C | yes | none | none | none |
| 71-1 | A C C A A A A A A | yes | none | none | none |
| 71-2 | A C C A A A C A A | yes | none | none | none |
| 71-3 | A C C A A C A A A | yes | none | none | none |
| 71-4 | A C C A A C C A A | yes | none | none | none |
| 71-5 | A C C A A A A A C | yes | none | none | none |
| 71-6 | A C C A A A C A C | yes | none | none | none |
| 71-7 | A C C A A C A A C | yes | none | none | none |
| 71-8 | A C C A A C C A C | yes | none | none | none |
| 71-9 | A C C A A A A C A | yes | none | none | none |
| 71-10 | A C C A A A C C A | yes | none | none | none |
| 71-11 | A C C A A C A C A | yes | none | none | none |
| 71-12 | A C C A A C C C A | yes | none | none | none |
| 71-13 | A C C A A A A C C | yes | none | none | none |
| 71-14 | A C C A A A C C C | yes | none | none | none |
| 71-15 | A C C A A C A C C | yes | none | none | none |
| 71-16 | A C C A A C C C C | yes | none | none | none |
| 73-1 | A C C A C A A A A | yes | none | none | none |
| 73-2 | A C C A C A C A A | yes | none | none | none |
| 73-3 | A C C A C C A A A | yes | none | none | none |
| 73-4 | A C C A C C C A A | yes | 0 | 0 | 0 |
| 73-5 | A C C A C A A A C | yes | none | none | none |
| 73-6 | A C C A C A C A C | yes | none | none | none |
| 73-7 | A C C A C C A A C | yes | none | yes | none |
| 73-8 | A C C A C C C A C | yes | none | none | none |
| 73-9 | A C C A C A A C A | yes | none | none | none |
| 73-10 | A C C A C A C C A | yes | none | none | none |
| 73-11 | A C C A C C A C A | yes | none | none | none |
| 73-12 | A C C A C C C C A | yes | none | none | none |
| 73-13 | A C C A C A A C C | yes | none | none | none |
| 73-14 | A C C A C A C C C | yes | none | none | none |
| 73-15 | A C C A C C A C C | yes | none | yes | none |
| 73-16 | A C C A C C C C C | yes | none | none | none |
| 74-1 | A C C C A A A A A | yes | none | none | none |
| 74-2 | A C C C A A C A A | yes | none | none | none |
| 74-3 | A C C C A C A A A | yes | none | none | none |
| 74-4 | A C C C A C C A A | yes | none | none | none |
| 74-5 | A C C C A A A A C | yes | none | none | none |
| 74-6 | A C C C A A C A C | yes | none | none | none |
| 74-7 | A C C C A C A A C | yes | none | none | none |
| 74-8 | A C C C A C C A C | yes | none | yes | none |
| 74-9 | A C C C A A A C A | yes | none | none | none |
| 74-10 | A C C C A A C C A | yes | none | yes | none |
| 74-11 | A C C C A C A C A | yes | none | none | none |
| 74-12 | A C C C A C C C A | yes | none | yes | none |
| 74-13 | A C C C A A A C C | yes | none | none | none |
| 74-14 | A C C C A A C C C | yes | none | none | none |
| 74-15 | A C C C A C A C C | yes | none | none | none |
| 74-16 | A C C C A C C C C | yes | none | none | none |
| 82-1 | C A A C C A A A A | yes | none | none | none |
| 82-2 | C A A C C A C A A | none | none | none | none |
| 82-3 | C A A C C C A A A | yes | none | none | none |
| 82-4 | C A A C C C C A A | none | none | none | none |
| 82-5 | C A A C C A A A C | yes | yes | none | none |
| 82-6 | C A A C C A C A C | none | 0 | 0 | 0 |
| 82-7 | C A A C C C A A C | yes | yes | yes | yes |
| 82-8 | C A A C C C C A C | none | 0 | 0 | 0 |
| 82-9 | C A A C C A A C A | yes | yes | yes | yes |
| 82-10 | C A A C C A C C A | none | 0 | 0 | 0 |
| 82-11 | C A A C C C A C A | yes | yes | yes | yes |
| 82-12 | C A A C C C C C A | none | 0 | 0 | 0 |
| 82-13 | C A A C C A A C C | yes | yes | none | yes |
| 82-14 | C A A C C A C C C | yes | none | none | yes |
| 82-15 | C A A C C C A C C | yes | none | yes | yes |
| 82-16 | C A A C C C C C C | yes | none | none | yes |
| 84-1 | C A A C A A A A A | yes | yes | none | none |
| 84-2 | C A A C A A C A A | none | 0 | 0 | 0 |
| 84-3 | C A A C A C A A A | yes | yes | yes | none |
| 84-4 | C A A C A C C A A | none | 0 | 0 | 0 |
| 84-5 | C A A C A A A A C | yes | yes | none | none |
| 84-6 | C A A C A A C A C | none | 0 | 0 | 0 |
| 84-7 | C A A C A C A A C | yes | none | none | none |
| 84-8 | C A A C A C C A C | none | 0 | 0 | 0 |
| 84-9 | C A A C A A A C A | yes | yes | yes | yes |
| 84-10 | C A A C A A C C A | none | 0 | 0 | 0 |
| 84-11 | C A A C A C A C A | yes | yes | yes | yes |
| 84-12 | C A A C A C C C A | none | 0 | 0 | 0 |
| 84-13 | C A A C A A A C C | none | 0 | 0 | 0 |
| 84-14 | C A A C A A C C C | none | 0 | 0 | 0 |
| 84-15 | C A A C A C A C C | none | 0 | 0 | 0 |
| 84-16 | C A A C A C C C C | none | 0 | 0 | 0 |

Receptor binding properties were analyzed only for constructs that were expressed. If a clone was weakly expressed, its receptor binding properties were analyzed only if its size allowed distinction from endogenous VEGF-A expression, or if its amino acid composition allowed removal of endogenous VEGF-A using monoclonal anti-VEGF-A antibodies (R&D Systems) prior to assaying receptor binding. Although the epitope recognized by this anti-VEGF-A antibody has not been characterized, our preliminary results indicate that the epitope is located within one or more of fragments 2, 3, 4, 7, or 9 of VEGF-A. Thus, antibody precipitation of endogenous VEGF-A was performed for all constructs in which fragments 2, 3, 4, 7, and 9 were derived from VEGF-C. Further mapping of the epitope of this antibody may allow similar examination of additional constructs. For example, if subsequent analysis indicates that the epitope does not reside in fragment 2, constructs in which fragment 2 was derived from VEGF-A can also be analyzed by this method. This procedure was performed for binding to VEGFR-1 or VEGFR-2, to assess how many low affinity binding hybrid molecules were not detected due to interference with endogenous VEGF. Failure to detect a signal or detection of a weak signal in the receptor binding assays does not conclusively demonstrate lack of or low receptor binding affinity. The intrinsic set-up of the experiment does not allow detection of low affinity binders of VEGFR-1 and VEGFR-2 that are weakly expressed. Thus, the binding assays may have failed to detect low affinity binders of VEGFR-1 and VEGFR-2 for some of the hybrid proteins that were weakly expressed.

In this assay, apparent low receptor binding affinity of a low-level-expressed hybrid molecule could be due to heterodimerization with endogenous VEGF. For example, if a hybrid protein has no receptor-affinity itself, but is able to dimerize with endogenous VEGF-A, such a heterodimer may be capable of binding one of more receptor(s) with low affinity. Purification of chimeric polypeptides of the invention (e.g., using immunoaffinity chromatography with an antibody that recognizes either the myc or HA tag sequences) and using the purified polypeptide in receptor binding assays will resolve any ambiguities caused by endogenous VEGF-A in conditioned media. Alternatively, the hybrid proteins will be expressed in insect cells, e.g., S9 cells, to avoid contamination with endogenous VEGF-A.

Lack of expression. or low level expression of a particular construct may be due to properties of the hybrid protein itself, variations in DNA quality, or may reflect mutations in the DNA acquired during construction of the hybrid clone. In the present case, all constructs were sequenced after the first ligation step, and selected clones were sequenced after the second ligation step. Analysis of these sequences indicated that no mutations occurred during the first step, and none of the sequences examined after the second step of construction contained mutations. Thus, any mutations present in the final clone most probably occurred during the final ligation step.

Thirty-six of the 512 clones were sequenced to determine the frequency with which constructs acquired mutations during construction of the clones that resulted in changes at the amino acid level. The constructs that were sequenced were clones 11-1 (SEQ ID NOS: 42-43), 11-16 (SEQ ID NOS: 44-45), 22-1 (SEQ ID NOS: 46-47), 22-16 (SEQ ID NOS: 48-49), 12-1 to 12-16 (SEQ ID NOS: 50-81), and 31-1 to 31-16 (SEQ ID NOS: 82-113). Only 2 of the 36 clones, 12-13 and 12-16, showed a deviation from the expected sequence. Clone 12-16 had undergone a loss of two base pairs at the ligation junction between N45 and C67, resulting in a frameshift mutation after the RCG triplet of fragment C5 and a stop codon only a few codons thereafter. Clone 12-13 had acquired a point mutation which results in the substitution of Asp by Asn at the last C-terminal amino acid of this hybrid protein.

From the 512 hybrid constructs examined, four were chosen for further analysis including sequencing to determine if any mutations occurred during construction of the hybrid protein and repetition of binding assays to confirm initial results. Results from binding assays of these four particular hybrid proteins: constructs 12-13, 12-11, 12-9, and 12-7 indicate that they show novel binding patterns that are not exhibited by known VEGF receptor ligands. 12-9 and 12-13 show binding to VEGFR-1 and VEGFR-3 but not VEGFR-2, whereas 12-7 and 12-11 exhibit binding to all three VEGF receptors.

These results show that it is possible by combinatorial approaches to provide VEGF-related growth factors having modified properties. The novel molecules constructed in some cases have been shown to have modified biological effects compared to their wild-type ancestors, and thus may be used in applications where specificity and fine-tuning of biological effects are necessary. In particular, these experiments demonstrate that it is possible to construct a "super-VEGF", such as clones 12-7 and 12-11, which binds all three known VEGFRs, and therefore should be uniquely potent in inducing vascular growth.

EXAMPLE 4

Examination of VEGF-A and VEGF-C Receptor Binding Epitopes

The VEGF-A/VEGF-C hybrid proteins can be used to examine interactions between VEGF-A or VEGF-C, and their receptors. Analysis of the results from the receptor binding assays, such as those described in Table 3 and Example 3, enable careful investigation of the receptor-binding epitopes of these two VEGF growth factors. The ability of particular hybrid proteins to bind one of the VEGF receptors may be correlated with the presence of one or more particular fragments derived from one of the parent molecules. Such data can help define the amino acid residues important for binding to a specific VEGF receptor. Knowledge of the precise receptor binding epitopes of a particular VEGF protein can facilitate the design of inhibitory molecules useful for therapeutic purposes.

Twenty-one VEGF residues important for interfacing with VEGFR-1 are indicated in large bold text:

(SEQ ID NO:1209)

GQNHHEVVKFMDVYQRSYCHPIETLVDIFQEYPDEIEYIFKPSCV

PLMRCGGCCNDEGLECVPTEESNITMQLMRIKPHQGQHIGEMSFLQ

HNKCECRPKKD

Figure 8:
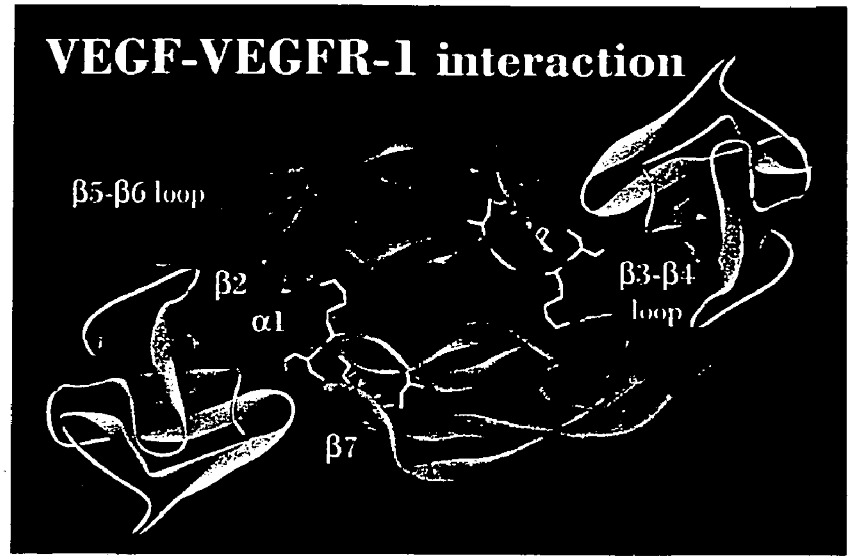
FIG. 8 is a three-dimensional model showing the interaction of a VEGF-A dimer with two VEGFR-1 molecules. The two VEGF-A monomers are colored in green and blue, respectively. The two VEGFR-1 receptors are depicted in gray. Red represents the location of residues within the VEGF-A monomers important for interfacing with VEGFR-1. These residues are clustered at the two ends of the VEGF-A dimer and include the N-terminal helix and part of the β5 strand.

Data from the chimera experiments indicates that those residues from fragment 2, which corresponds to the N-terminal helix and residues from fragment 7, which corresponds to strand β5 appear particularly important for conferring VEGFR-1 specificity. FIG. 8 is a three dimensional model of the interaction of a VEGF-A dimer with two VEGFR-1 molecules. The two VEGF-A monomers are colored in green and blue, respectively. Domain 2 of the two VEGFR-1 receptors are depicted in gray. Red represents the location of residues within the VEGF-A monomers important for VEGFR-1 interfacing. These residues are clustered at the two ends of the VEGF dimer and include the N-terminal helix and part of the β5 strand.

The corresponding twenty-one residues in VEGF-C that would analogously be involved in interfacing VEGFR-3 are indicated below in large bold text:

(SEQ ID NO:1210)

AHYNTEILKSIDNEWRKTQCMPREVCIDVGKEFGVATNTFFKPPCVS

VYRCGGCCNSEGLQCMNTSTSYLSKTLFEITVPLSQGPKPVTISFA

NHTSCRCMSKLD

Figure 10:
FIG. 10 is a three-dimensional model of a the interaction between a VEGF-C dimer and a single VEGFR-3 molecule, extrapolated from the VEGF-A/VEGFR-A model. Blue and green represent the two VEGF-C monomers and grey represents VEGFR-3. Fragment 5 of the green VEGF-C monomer is shown in orange and fragment 4 of the same monomer is shown in white. Residues in red are those located within fragment 4 or 5 that are probably in contact with the receptor.

Interestingly, analysis of the receptor binding patterns from the chimera experiments indicates that a VEGF-C-derived fragment 4 (containing the β2 strand of the molecule) is absolutely required for VEGFR-3 binding specificity. Fragments 5 (which includes the β3 strand) and 8 appear to represent two other important VEGF-C fragments for VEGFR-3 binding. The amino acid sequence of VEGF-C fragments 4 and 5 is EFGVATNTFFKPPCVSVYRCG (SEQ ID NO: 1205). The TNTFxxxP quintet of residues (SEQ ID NO: 1204) is particularly noteworthy because these residues are conserved in human, quail, and bovine VEGF-C and human VEGF-D, all of which bind VEGFR-3. The analogous residues in human VEGF-A, which does not bind VEGFR-3, differ: IEYIxxxS (SEQ ID NO: 1211). FIG. 10 is a three-dimensional model of the interaction between portions of a VEGF-C dimer and a single VEGFR-3 molecule, extrapolated from the VEGF-A/VEGFR-1 model. Blue and green represent the two VEGF-C monomers and grey represents VEGFR-3. Fragment 5 of the green VEGF-C monomer is shown in orange and fragment 4 of the same monomer is shown in white. Residues in red are those located within fragment 4 or 5 that are probably in contact with the receptor.

Figure 9:
FIG. 9 is a three-dimensional model depicting the groove formed by a VEGF-C dimer. The entry and the sides of this groove are formed by the fragments, described in Example 4, that appear to be important for conferring VEGFR-3 specificity. The green and blue indicate the two VEGF-C monomers and the gray indicates a VEGFR-3 receptor molecule. The VEGF-C residues that participate in binding VEGFR-3 are indicated in yellow.

FIG. 9 is a three-dimensional model that depicts the groove formed by the fragments that appear to be important for VEGFR-3 specificity. This groove is speculated to accommodate the linker region between domain 2 and 3 of the VEGFR-3 receptor. The entry and the sides of this groove are formed by the fragments that appear to be important for confering VEGFR-3 specificity. The green and blue indicate the two VEGF-C monomers and the gray indicates the VEGFR-3 receptor molecule. The VEGF-C residues that are believed to participate in binding VEGFR-3 are indicated in yellow.

Although fragments 6 and 9 are involved in interaction with the VEGF receptors, these fragments do not appear to be involved in determining receptor specificity.

EXAMPLE 5

Analysis of Receptor Activation or Inhibition by the Hybrid VEGF Proteins

The VEGF-A/VEGF-C hybrid proteins may be used for therapeutic applications where either activation of inhibition of one or more VEGF receptors is desired. For example, a candidate hybrid protein can be added to stable cell lines expressing a particular VEGF receptor whose activation is necessary for cell survival. Survival of the cell line indicates that the candidate hybrid protein is able to bind and activate that particular VEGF receptor. On the other hand, death of the cell line indicates that the candidate hybrid protein fails to activate the receptor. Exemplary examples of such cell-survival assays have been described in International Patent Publication No. WO 98/07832 and in Achen et al., *Proc Natl Acad Sci USA* 95:548-553 (1998), incorporated herein by reference. This assay employs Ba/F3-NYK-EpoR cells, which are Ba/F3 pre-B cells that have been transfected with a plasmid encoding a chimeric receptor consisting of the extracellular domain of VEGFR-2 and the cytoplasmic domain of the erythropoietin receptor (EpoR). These cells are routinely passaged in interleukin-3 (IL-3) and will die in the absence of IL-3. However, if signaling is induced from the cytoplasmic domain of the chimeric receptor, these cells survive and proliferate in the absence of IL-3. Such signaling is induced by ligands which bind to the VEGFR-2 extracellular domain of the chimeric receptor. For example, binding of VEGF-A or VEGF-D to the VEGFR-2 extracellular domain causes the cells to survive and proliferate in the absence of L-3. Parental Ba/F3 cells which lack the chimeric receptor are not induced by either VEGF-A or VEGF-D to proliferate in the absence of IL-3, indicating that the responses of the Ba/F3-NYK-EpoR cells to these ligands are totally dependent on the chimeric receptor.

Candidate hybrid proteins can be tested for binding to the VEGFR-2 extracellular domain and subsequent activation of the chimeric receptor by assaying cell survival in the absence of IL-3. On the other hand, hybrid proteins that interfere with the binding of VEGFR-2 ligands, such as VEGF-A or VEGF-D, to the extracellular domain, or with the activation of the cytoplasmic domain, will cause cell death in the absence of IL-3.

Cells are cultured in the presence of IL-3 until required, then washed three times in phosphate buffered saline (PBS), resuspended in IL-3-free cell culture medium (Dulbecco's Modified Eagle's Medium (DMEM) supplemented with fetal calf serum (10%), L-glutamine (1%), geneticin (1 mg/ml), streptomycin (100 μg/ml) and penicillin (60 μg/ml)), and replated in 72-well culture plates (Nunc, Denmark) at a density of approximately 1000 cells/well. To assay for receptor activity, candidate hybrid proteins are added to culture wells at final concentrations of $10^{-10}$ to $10^{-5}$ M and incubated for 1 hour at 37° C. in 10% $CO_2$. For assaying the ability of the candidate hybrid protein to inhibit activation of the VEGFR-2/EpoR receptor, recombinant VEGF-A or VEGF-D is added to the hybrid protein-containing wells at a concentration to produce near-maximal survival of the Ba/F3-NYK-EpoR cells (typically 500 ng/ml). Positive control cultures contain either VEGF-A or VEGF-D supematant alone and negative control cultures contain neither hybrid protein nor growth factor. Cells are then grown in culture for 48 hours, after which time a solution of 3-(3,4-dimethylthiazol-2-yl)-2,5-diphenyltetrazolium bromide (MTT; 500 μg/ml) is added to the cultures, and incubated for another 30 minutes. MTT is converted to a blue formazan product by mitochondria, thus staining living cells blue. Surviving blue cells in experiments where either activation (hybrid protein alone) or inhibition (hybrid protein+VEGF-A or VEGF-D) was assayed are counted under a microscope with inverted optics (100× magnification) and compared to cell survival in the positive control (VEGF-A or VEGF-D only) wells. Cell survival is normalized such that survival in negative controls is set to 0 (typically no viable cells were seen in negative controls), while survival in positive controls is set to 100% (typically 300-400 cells/well).

Data is analyzed by one way analysis of variance (ANOVA), with a Bonferroni multiple comparisons test carried out post-hoc to test for differences between individual cultures of hybrid protein alone (to assay binding and activation of the receptor), or hybrid protein+VEGF-A or VEGF-D (to assay inhibition of receptor activation), with VEGF-A or VEGF-D alone (positive control).

Repetition of the same assay using cells transfected with different chimeric receptors (e.g., VEGFR-3/EpoR) allows screening for activation of different VEGFRs.

VEGFR-2 (KDR) and VEGFR-3 (Flt4) Autophosphorvlation Assays

As an alternative indicator of activity, the ability of a hybrid protein to stimulate autophosphorylation of a particular VEGF receptor can also be examined. A candidate hybrid protein is added to cells expressing a particular VEGF receptor. The cells are then lysed and immuoprecipitated with anti-VEGF receptor antiserum and analyzed by Western blotting using anti-phosphotyrosine antibodies to determine hybrid protein-induced phosphorylation of the VEGF receptor.

An expression vector comprising a polynucleotide encoding a hybrid VEGF molecule of the invention is transfected into an appropriate host cell (e.g., 293-EBNA cells using a calcium phosphate transfection method. About 48 hours after transfection, the growth medium of the transfected cells is changed (e.g., to DMEM medium lacking fetal calf serum) and the cells are incubated (e.g, for 36 more hours) to provide a conditioned medium. The conditioned medium is collected and centrifuged at 5000×g for 20 minutes, and the supernatant is concentrated.

The concentrated conditioned media is used to stimulate cells expressing a VEGF receptor. For example, PAE-KDR cells (Pajusola et al., *Oncogene,* 9:3545-55 (1994); Waltenberger et al., *J. Biol. Chem.,* 269:26988-26995 (1994)) are grown in Ham's F12 medium-10% fetal calf serum (FCS), or confluent NIH 3T3 cells expressing VEGFR-3 are grown in DMEM medium. The cells are starved overnight in DMEM medium or Ham's F12 supplemented with 0.2% bovine serum albumin (BSA), and then incubated for 5 minutes with the unconcentrated, 2-fold, 5-fold, and/or 10-fold concentrated conditioned media. Recombinant human VEGF-A or VEGF-C and conditioned media from mock-transfected cells are exemplary controls. In addition to conditional media, purified hybrid polypeptide can be employed in this or other assays described herein.

After stimulation with conditioned media, the cells are washed twice with ice-cold Tris-Buffered Saline (TBS) containing 100 mM sodium orthovanadate and lysed in RIPA buffer containing 1 mM phenylmethylsulfonyl fluoride (PMSF), 0.1 U/ml aprotinin and 1 mM sodium orthovanadate. The lysates are sonicated, clarified by centrifugation at 16,000×g for 20 minutes and incubated for 3-6 hours on ice with 3-5 μl of antisera specific for VEGFR-3 or VEGFR-2. Immunoprecipitates are bound to protein A-Sepharose, washed three times with RIPA buffer containing 1 mM PMSF, 1 mM sodium orthovanadate, washed twice with 10 mM Tris-HCl (pH 7.4), and subjected to SDS-PAGE using a 7% gel. Polypeptides are transferred to nitrocellulose by Western blotting and analyzed using PY20 phosphotyrosine-specific monoclonal antibodies (Transduction Laboratories) or receptor-specific antiserum and the ECL detection method (Amersham Corp.).

The ability of a hybrid polypeptide to stimulate autophosphorylation (detected using the anti-phosphotyrosine antibodies) is scored as stimulating the receptor. The level of stimulation observed for various concentrations of hybrid polypeptide, relative to known concentrations of VEGF-A or VEGF-C, provide an indication of the potency of receptor stimulation. Polypeptides that have been shown to bind the receptor, but are incapable of stimulating receptor phosphorylation, are scored as inhibitors. Inhibitory activity can be further assayed by mixing a known receptor agonist such as recombinant VEGF-A or VEGF-C with either media alone or with concentrated conditioned media, to determine if the concentrated conditioned media inhibits VEGF-A-mediated or VEGF-C-mediated receptor phosphorylation.

In initial experiments to study tyrosine phosphorylation of VEGFR-2 and VEGFR-3 mediated by selected hybrid molecules which bind VEGFR-2 or VEGFR-3, it was observed that all hybrid proteins tested were able to induce phosphorylation of the receptors, however to a lesser extent than that mediated by VEGF-A or VEGF-C. Further examination of the expression levels of the hybrid proteins in the baculovirus system used to produce the proteins indicate that the proteins are not all expressed in comparable amounts. Differential expression levels of the hybrid proteins may explain some of the lower activities exhibited by these proteins in assaying their ability to stimulate tyrosine phosphorylation of VEGFR-2 and VEGFR-3. In addition, the extent of phosphorylation induced by these hybrid molecules determined using this particular assay may not correlate with biological activity in vivo.

EXAMPLE 6

Analysis of Receptor Binding Affinities of Hybrid Proteins

Preliminary analysis of the 512 hybrid proteins indicate that a number of them are able to bind one of more of the VEGFRs. In addition, results from these experiments suggest that some show differential binding affinities to one of more VEGFRs. For these experiments, the hybrid protein is expressed in an insect cell system, e.g., S9 cells, to eliminate contamination with endogenous VEGF-A found in mammalian cells. To measure the relative binding affinities of selected hybrid proteins, an ELISA-type approach is used. For example, to examine binding affinity for VEGFR-1, serial dilutions of competing VEGFR-1-IgG fusion proteins and a subsaturating concentration of the candidate hybrid protein tagged with the myc epitope is added to microtitre plates coated with VEGFR-1, and incubated until equilibrium is established. The plates are then washed to remove unbound proteins. Hybrid molecules that remain bound to the VEGFR-1 coated plates are detected using an anti-myc antibody conjugated to a readily detectable label e.g., horseradish peroxidase. Binding affinities (EC50) can be calculated as the concentration of competing VEGFR-IgG fusion protein that results in half-maximal binding. These values can be compared with those obtained from analysis of VEGF-A or VEGF-C to determine changes in binding affinity of one or more of the VEGFRs. Similarly, binding to VEGFR-2 is accomplished by using a VEGFR-2-IgG fusion protein, and binding to VEGFR-3 is determined using a VEGFR-3-IgG fusion protein.

EXAMPLE 7

Endothelial Cell Migration in Collagen Gel Mediated by VEGF-A/VEGF-C Hybrid Proteins Both VEGF-A and VEGF-C stimulate endothelial cell migration in collagen gel. The hybrid proteins of the invention are examined to determine if they are also capable of stimulating endothelial cell migration in collagen gel, thus providing another indicia of biological activity. Exemplary examples of such cell migration assays have been described in International Patent Publication No. WO 98/33917, incorporated herein by reference. Briefly, bovine capillary endothelial cells (BCE) are seeded on top of a collagen layer in tissue culture plates. Conditioned media from cells transfected with an expression vector producing the candidate hybrid protein is placed in wells made in collagen gel approximately 4 mm away from the location of the attached BCE cells. The number of BCE cells that have migrated from the original area of attachment in the collagen gel towards the wells containing the hybrid protein is then counted to assess the ability of the hybrid protein to induce cell migration.

BCE cells (Folkman et al., *Proc. Natl. Acad. Sci.* (USA), 76:5217-5221 (1979)) are cultured as described in Pertovaara et al., *J. Biol. Chem.,* 269:6271-74 (1994). Collagen gels are prepared by mixing type I collagen stock solution (5 mg/ml in 1 mM HCl) with an equal volume of 2×MEM and 2 volumes of MEM containing 10% newborn calf serum to give a final collagen concentration of 1.25 mg/ml. Tissue culture plates (5 cm diameter) are coated with about 1 mm thick layer of the solution, which is allowed to polymerize at 37° C. BCE cells are seeded atop this layer.

For the migration assays, the cells are allowed to attach inside a plastic ring (1 cm diameter) placed on top of the first collagen layer. After 30 minutes, the ring is removed and unattached cells are rinsed away. A second layer of collagen and a layer of growth medium (5% newborn calf serum (NCS)), solidified by 0.75% low melting point agar (FMC BioProducts, Rockland, Me.), are added. A well (3 mm diameter) is punched through all the layers on both sides of the cell spot at a distance of 4 mm, and media containing a hybrid VEGF polypeptide (or media alone or media containing VEGF-A or VEGF-C to serve as controls) is pipetted daily into the wells. Photomicrographs of the cells migrating out from the spot edge are taken, e.g., after six days, through an Olympus CK 2 inverted microscope equipped with phase-contrast optics. The migrating cells are counted after nuclear staining with the fluorescent dye bisbenzimide (1 mg/ml, Hoechst 33258, Sigma).

The number of cells migrating at different distances from the original area of attachment towards wells containing media conditioned by the non-transfected (control) or transfected (mock; hybrid; VEGF-C; or VEGF-A) cells are determined 6 days after addition of the media. The number of cells migrating out from the original ring of attachment are counted in five adjacent 0.5 mm×0.5 mm squares using a microscope ocular lens grid and 10× magnification with a fluorescence microscope. Cells migrating further than 0.5 mm are counted in a similar way by moving the grid in 0.5 mm steps.

The ability of a hybrid polypeptide to induce migration of BCE cells in indicative of receptor agonist activity. The number of migrating cells in the presence of a hybrid protein versus a similar concentration of VEGF-A or VEGF-C provides an indication of the potency of agonist activity. Polypeptides that have been shown to bind the receptors expressed on BCE cells, but are incapable of stimulating migration, are scored as potential inhibitors. Inhibitory activity can be further assayed by mixing a known receptor agonist such as recombinant VEGF-A or VEGF-C with either media alone or with concentrated conditioned media, to determine if the concentrated conditioned media inhibits VEGF-A-mediated or VEGF-C-mediated BCE migration.

EXAMPLE 8

Analysis of the Ability of Hybrid Proteins to Induce Cascular Permeability

Both VEGF-A and VEGF-C are capable of increasing the permeability of blood vessels. The hybrid proteins of the invention are assayed to determine which of these proteins possess this biological activity and which inhibit it. For example, vascular permeability assays according to Miles and Miles, *J. Physiol* 118:228-257 (1952), incorporated herein in its entirety, are used to analyze the hybrid proteins. Briefly, following intravenous injection of a vital dye, such as pontamine sky blue, animals such as guinea pigs are injected intradermally with a composition containing the candidate hybrid protein being examined. For controls, media alone or media containing VEGF-A or VEGF-C is injected in the same manner. After a period of time, the accumulation of dye at the injection site on the skin is measured. Those hybrid proteins that increase permeability will result in greater accumulation of dye at the injection site as compared to those hybrid proteins that fail to induce vascular permeability.

In a variation of this assay, hybrid polypeptides that are suspected of being inhibitors of VEGF-A or VEGF-C are first mixed with VEGF-A or with VEGF-C at varying ratios (e.g., 50:1, 10:1, 5:1, 2:1, 1:1, 1:2, 1:5, 1:10) and the mixtures are injected intradermally into the animals. In this manner, the ability of the hybrid polypeptide to inhibit VEGF-A-mediated or VEGF-C-mediated vascular permeability is assayed.

EXAMPLE 9

Endothelial Cell Proliferation Assay

The mitogenic activity of hybrid proteins can be examined using endothelial cell proliferation assays such as that described in Breier et al., *Dev* 114:521-532 (1992), incorporated herein in its entirety. The hybrid proteins are expressed in a mammalian cell line e.g., COS cells. Culture supernatants are then collected and assayed for mitogenic activity on bovine aortic endothelial (BAE) cells by adding the supernatants to the BAE cells. After three days, the cells are dissociated with trypsin and counted using a cytometer to determine any effects of the hybrid protein on the proliferative activity of the BAE cells. As negative controls, DMEM supplemented with 10% FCS and the conditioned media from untransfected COS cells or from COS cells transfected with vector alone can be used. Supernatants from cells transfected with constructs expressing proteins that have been shown to induce proliferation of BAE cells (e.g., VEGF-A) can be used as a positive control.

EXAMPLE 10

Examination of the Ability of Hybrid Proteins Expressed Through the Human K14 Keratin Promoter to Induce Growth of Lymphatic Vessels in Skin of Transgenic Mice Experiments are conducted in transgenic mice to analyze the specific effects of overexpression of hybrid proteins in tissues. The physiological effects in vivo provide an indication of receptor activation/inhibition profile and an indication of the potential therapeutic action of a hybrid protein. In one variation, the human K14 keratin promoter which is active in the basal cells of stratified squamous epithelia [Vassar et al., *Proc. Natl. Acad. Sci.* (USA), 86:1563-1567 (1989)], is used as the expression control element in the recombinant hybrid protein transgene. The vector containing the K14 keratin promoter is described in Vassar et al., *Genes Dev.,* 5:714-727 (1991) and Nelson et al., *J. Cell Biol.* 97:244-251 (1983).

A DNA fragment containing the K14 promoter, hybrid protein cDNA, and K14 polyadenylation signal is synthesized, isolated, and injected into fertilized oocytes of the FVB-NIH mouse strain. The injected zygotes are transplanted to oviducts of pseudopregnant C57BL/6×DBA/2J hybrid mice. The resulting founder mice are then analyzed for the presence of the transgene by polymerase chain reaction of tail DNA using appropriate primers or by Southern analysis.

These transgenic mice are then examined for evidence of angiogenesis or lymphangiogenesis in the skin, such as the lymphangiogenesis seen in transgenic mice that overexpress VEGF-C [see International Publication WO98/33917]. Histological examination of K14-VEGF-C transgenic mice showed that in comparison to the skin of wildtype littermates, the dorsal dermis was atrophic and connective tissue was replaced by large lacunae devoid of red cells, but lined with a thin endothelial layer. These distended vessel-like structures resembled those seen in human lymphangiomas. The number of skin adnexal organs and hair follicles were reduced. In the snout region, an increased number of vessels was also seen.

Examination of the vessels in the skin of the transgenic mice using antibodies that recognize proteins specific for either blood or lymphatic vessels can further verify the identity of these vessels. Collagen types IV, XVIII [Muragaki et al., *Proc. Natl. Acad. Sci. USA,* 92: 8763-8776 (1995)] and laminin are expressed in vascular endothelial cells while desmoplakins I and II (Progen) are expressed in lymphatic endothelial cells. See Schmelz et al., *Differentiation,* 57: 97-117 (1994).

EXAMPLE 11

Analysis of Hybrid Proteins in Promoting or Inhibiting Myelopoiesis

Overexpression of VEGF-C in the skin of K14-VEGF-C transgenic mice correlates with a distinct alteration in leukocyte populations [see International Publication WO98/33917]. Notably, the measured populations of neutrophils were markedly increased in the transgenic mice. The effects of the hybrid proteins on hematopoiesis can be analyzed using fluorescence-activated cell sorting analysis using antibodies that recognize proteins expressed on specific leukocyte cell populations. Leukocytes populations are analyzed in blood samples taken from the F1 transgenic mice described in Example 13, and from their non-transgenic littermates.

EXAMPLE 12

Effects of Hybrid Proteins on Growth and Differentiation of Human CD34+ Progenitor Cells in vitro Addition of VEGF-C to cultures of cord blood CD34+ cells induces cell proliferation. Co-culture of GM-CSF, IL-3, GM-CSF+L-3, or GM-CSF+SCF with VEGF-C leads to an enhancement of proportions of myeloid cells [see International Publication WO98/33917]. Hybrid proteins of the invention can also be examined for their ability to induce growth of CD34+ progenitor cells in vitro. Human CD34+ progenitor cells (HPC, $10\times10^3$) are isolated from bone marrow or cord blood mononuclear cells using the MACS CD34 Progenitor cell Isolation Kit (Miltenyi Biotec, Bergish Gladbach, Germany), according to the instructions of the manufacturer and cultured in RPMI 1640 medium supplemented with L-glutamine (2.5 mM), penicillin (125 IE/ml), streptomycin (125 μg/ml) and pooled 10% umbilical cord blood (CB) plasma at 37° C. in a humidified atmosphere in the presence of 5% $CO_2$ for seven days, with or without hybrid protein at concentrations ranging from 10 ng/ml to 1 μg/ml. After seven days, total cell number is evaluated in each culture.

The co-stimulatory effect of hybrid proteins in cultures either supplemented with recombinant human stem cell factor (rhSCF, 20 ng/ml PreproTech, Rocky Hill, N.Y.) alone or a combination of granulocyte macrophage colony stimulating factor (rhGM-CSF, 100 ng/ml, Sandoz, Basel, Switzerland) plus SCF can also be examined. Experiments can also be conducted to analyze the co-stimulatory effects of hybrid protein on total cell yields of serum-free cultures of CB CD34+ HPC cells supplemented with either GM-CSF alone, IL-3 (rhIL-3, 100 U/ml, Behring AG, Marburg, Germany) alone; or a combination of GM-CSF plus IL-3.

Cells from the (7 day) plasma-supplemented cultures described above are also analyzed for the expression of the early granulomonocytic marker molecules lysozyme (LZ) and myeloperoxidase (MPO) as well as the lipopolysaccharide (LPS) receptor CD14 using immunofluorescence.

In another series of experiments, CD34+ cells are cultured in medium supplemented with 50 ng/ml M-CSF, with or without 100 ng/ml hybrid protein, for seven days. After seven days, the cultures were analyzed to determine the percentages of CD14+ cells and mean fluorescence intensity.

EXAMPLE 13

Analysis of Hybrid Proteins Using CAM Assays

The choroallantoic membrane (CAM) assay described in e.g., Oh et al., *Dev Biol* 188:96-109 (1997), incorporated herein in its entirety, is a commonly used method to examine the in vivo effects of angiogenic factors. Using this assay, VEGF growth factors. including both VEGF-A and VEGF-C have been shown to induce the development of blood vessels [Oh et al., *Dev Biol* 188:96-109 (1997)]. Thus, this method can be used to study the angiogenic properties of the hybrid proteins.

Briefly, on day 4 of development, a window is cut out into the eggshell of chick or quail eggs. The embryos are checked for normal development, the window in the eggshell is sealed with cellotape, and the eggs are incubated until day 13 of development. Approximately 3.3 μg of hybrid protein dissolved in 5 μl of distilled water is added to Thermanox coverslips (Nunc, Naperville, Ill.), which have been cut into disks with diameters of approximately 5 mm, and air dried. Disks without added protein are used as controls. The dried disks are then applied on the chorioallantoic membrane (CAM) of the eggs. After 3 days, the disks are removed and fixed in 3% glutaraldehyde and 2% formaldehyde and rinsed in 0.12 M sodium cacodylate buffer. The fixed specimens are photographed and embedded in Epon resin (Serva, Germany) for semi-(0.75 μm) and ultrathin (70 nm) sectioning. Both semi- and ultrathin sections are cut using an Ultracut S (Leika, Germany). Ultrathins sections are analyzed by an EM 10 (Zeiss, Germany). Specimens are then analyzed for evidence of growth of new capillaries, which would indicate that the hybrid protein being examined is capable of stimulating angiogenesis.

EXAMPLE 14

Analysis of Homo- or Hetero Dimerization of the VEGF-A/VEGF-C Hybrid Proteins Activation of tyrosine receptors is commonly mediated by ligand-induced receptor dimerization. Investigation of interactions between VEGF and VEGFR-2 indicate that receptor dimerization is accomplished via ligand dimerization in which both receptors bind parts of each of the two ligand proteins that constitute the homo- or heterodimer. Mutant VEGF proteins that can bind to VEGFR-2 but are unable to dimerize, cannot activate the receptor [Fuh et al., *J Biol Chem* 273:11197-11204 (1998)]. All of the VEGF family members are capable of homo- and/or heterodimerization. VEGF-A and VEGF-C fail to heterodimerize with each other. However, some of the VEGF-A/VEGF-C hybrid proteins may dimerize with each other or with one or both of the parent molecules. The hybrid proteins may also be capable of homodimerization. The following protocols are designed to identify dimerization capabilities of the hybrid proteins of the invention. A candidate hybrid protein is co-expressed with a different hybrid protein or one of the parent molecules in a cell line e.g., 293T or S9 cells. Extracts from these cells are prepared and used for immunoprecipitation using an antibody that recognizes only one of the two proteins being examined. The immunoprecipitated proteins are then subjected to SDS-PAGE and analyzed. If both proteins are detected on the gel, heterodimerization occurred between the two proteins being examined. On the other hand, if only the protein recognized by the antibody used during immunoprecipitation is detected, dimerization failed to occur between the two proteins. Since dimerization appears to be critical for receptor activation, hybrid proteins that bind receptor but Feb. 16, 2000 fail to dimerize with self or with natural VEGF growth factors endogenously expressed by cells are expected to be inhibitors of endogenous vascular endothelial growth factor activity.

Heterodimers comprising a polypeptide of the invention with other polypeptides of the invention or with naturally occurring members of the VEGF family of growth factors may be generated essentially as described in Cao et al., *J. Biol. Chem.,* 271:3154-62 (1996). Briefly, a recombinantly produced hybrid polypeptide is mixed at an equimolar ratio with another recombinantly produced polypeptide of interest, such as a VEGF-A, VEGF-B, VEGF-C, VEGF-D, PlGF, PDGFα, PDGFβ, or c-fos induced growth factor polypeptide. (See, e.g., Collins et al., *Nature,* 316:748-750 (1985) (PDGF-β, GenBank Acc. No. X02811); Claesson-Welsh et al., *Proc. Natl. Acad. Sci. USA,* 86(13):4917-4921 (1989) (PDGF-α, GenBank Acc. No. M22734); Claesson-Welsh et al., *Mol. Cell. Biol.* 8:3476-3486 (1988) (PDGF-β, GenBank Acc. No. M21616); Olofsson et al., *Proc. Natl. Acad. Sci.* (USA), 93:2576-2581 (1996) (VEGF-B, GenBank Acc. No. U48801); Maglione et al., *Proc. Natl. Acad. Sci.* (USA), 88(20):9267-9271 (1996) (PlGF, GenBank Acc. No. X54936); Heldin et al., *Growth Factors,* 8:245-252 (1993); Folkman, *Nature Med.,* 1:27-31 (1995); Friesel et al., *FASEB J.,* 9:919-25 (1995); Mustonen et al., *J. Cell. Biol.,* 129:895-98 (1995); Orlandini, S., *Proc. Natl. Acad. Sci. USA,* 93(21): 11675-11680 (1996); and others cited elsewhere herein. The mixed polypeptides are incubated in the presence of guanidine-HCl and DTT. The thiol groups are then protected with S-sulfonation, and the protein is dialyzed overnight, initially against urea/glutathione-SH, glutathione-S-S-glutathione, and subsequently against 20 mM Tris-HCl.

The heterodimers are screened to determine their binding affinity with respect to receptors of the VEGF/PDGF family (especially VEGFR-1, VEGFR-2, and VEGFR-3), and their ability to stimulate the receptors (e.g., assaying for dimer-stimulated receptor phosphorylation in cells expressing the receptor of interest on their surface). The binding assays may be competitive binding assays such as those described herein and in the art. In the initial binding assays, recombinantly produced proteins comprising the extracellular domains of receptors are employable, as described in preceding examples for VEGFR-2 and VEGFR-3. Heterodimers that bind and stimulate receptors are useful as recombinant growth factor polypeptides. Heterodimers that bind but do not stimulate receptors are useful as growth factor antagonists. Heterodimers that display agonistic or antagonistic activities in the screening assays are further screened using e.g., endothelial cell migration assays, vascular permeability assays, and in vivo assays. It will also be apparent from the preceding examples that dimers comprising two VEGF-C polypeptides (i.e., dimers of identical VEGF-C polypeptides as well as dimers of different VEGF-C polypeptides) are advantageously screened for agonistic and antagonistic activities using the same assays.

EXAMPLE 15

Determination of Biological Half-Life of the VEGF-A/VEGF-C Hybrid Proteins

Knowledge of the in vivo biological half-life of a compound is valuable for therapeutic applications. Although the biological half-life of the hybrid proteins has not been determined in vivo, preliminary results in vitro indicate that the VEGF-A/VEGF-C hybrid proteins described above exhibit different half-lives. Incubation of cell supernatants containing specific hybrid proteins at 4° C. for approximately two months reveal different protein stabilities for the various hybrid proteins. Examination of the in vivo biological half-life can be determined by injecting iodine-labeled hybrid protein into animals. Briefly, 50 μg of hybrid protein are iodinated using IODO-GEN (Pierce) according to the manufacturer's instructions to a specific radioactivity of approximately 2-10 μCi/μg protein. The iodinated protein is purified using PD-10 Sephadex (Pharmacia) according to the manufacturer's instructions. 12-16 week old mice (weighing 20-25 g) are anesthetized with sodium pentobarbital (1 mg/20 g body weight mouse) during the course of the experiment. 5-10 pmol of the radiolabeled protein diluted in 100 μl sterile saline are is injected into the tail vein over 30 seconds. At specific time points (1 min, 2 min, 4 min, 8 min, 15 min, 30 min, 60 min, and 120 min), 40-50 μl of blood is collected by periorbital bleeding or form the tail artery. 25 μl of the plasma fraction of each blood sample is then spotted onto Whatman filter paper, precipitated with 10% trichloroacetic acid (TCA), and rinsed with ethanol. The amount of radiolabeled protein present in the plasma fraction is determined by quantifying the radioactivity using a gamma counter. Polypeptides that display improved half-life relative to that of naturally occurring VEGFs are a preferred genus of polypeptides of the invention. Polypeptides that show 25%, 50%, 75% or 100% improvement of half-life to that of naturally occurring VEGFs are highly preferred.

EXAMPLE 16

Construction of Hybrid Molecules Using Other VEGF or PDGF Family Proteins

The procedure described in Example 1 can be extended to create hybrid molecules using any of the PDGF/VEGF growth factors. Members of the PDGF/VEGF family, which comprises at least VEGF-A (SEQ ID NOS: 1 and 2), PlGF (SEQ ID NOS: 114 and 115), VEGF-B (SEQ ID NOS: 116 and 117), VEGF-C (SEQ ID NOS: 21 and 22), VEGF-D (SEQ ID NOS: 118 and 119), VEGF-E (SEQ ID NOS: 120 and 121), and NZ2 VEGF (SEQ ID NOS: 122 and 123), D1701 VEGF (SEQ ID NOS: 150 and 151); NZ10 VEGF [described in SEQ ID NO: 11 of International Patent Application PCT/US99/25869, incorporated herein in its entirety]; PDGF-A (SEQ ID NO: 124 and 125), PDGF-B (SEQ ID NO: 126 and 127), and fallotein (SEQ ID NO: 148 & 149) share sufficient homology with each other within the receptor binding domain to permit designing oligonucleotides with unique cohesive ends as taught in Example 1 with respect to VEGF-A and VEFG-C. As shown by the successful results in Examples 1-3, oligonucleotides designed to provide double-stranded fragments having cohesive ends as short as 3-6 bases in length are sufficient to permit successful recombination into novel hybrid molecules (with very few unintended mutations).

While the presence of cohesive ends greatly facilitated ligation of fragments in a desired order and orientation, it will be appreciated that ligation of fragments can also be accomplished without cohesive ends. Blunt-end fragments also can be synthesized and annealed to generate hybrid proteins using the method described above. With a blunt-end strategy, the nucleotide sequences of the parent molecules do not need to be examined for the presence of nucleotide identity to enable the creation of cohesive ends. However, additional post-ligation screening may be required to identify hybrids that contain fragments in the desired order and orientation.

Using such guidelines, oligonucleotide pairs are designed and annealed as described in Example 1 to provide DNA fragments of the receptor for binding domain of two or more VEGF proteins. Combinatorial ligation of the various DNA fragments produces novel hybrid polypeptides that are screened for receptor binding and for biological properties such as ability to stimulate or inhibit endothelial cell growth and migration and modulate vascular permeability.

EXAMPLE 17

Generation of Hybrid Molecules Using PCR-Driven DNA Shuffling

The following protocol provides an alternative "DNA shuffling" methodology for generating hybrid vascular endothelial growth factor-encoding polynucleotides and polypeptides. DNA shuffling procedures have been described in the literature for enzymes such as antibiotic-resistance-conferring proteins, and a few other protein families. [See, e.g., Chang et al., *Nature Biotechnology,* 17: 793-797 (1999); Kikuchi et al., *Gene,* 236: 159-167 (1999); Harayama et al., *TIBTECH,* 16: 76-82 (1998); Crameri et al., *Nature,* 391: 288-291 (1998); Patten et al., *Curr. Opin. Biotechnology,* 8: 724-733 (1997); Zhang et al., *Proc. Natl. Acad. Sci. USA,* 94: 4504-09 (1997); Stemmer, *Proc. Natl. Accd. Sci. USA,* 91: 10747-1074 (1994); and Stemmer, *Nature,* 370: 389-391 (1994), all incorporated herein by reference in their entirety.]

Two or more cDNAs encoding vascular endothelial growth factor polypeptides are first cloned and amplified. In a preferred embodiment, only those portions of the cDNAs that encode minimum VEGF receptor-binding domains, and optionally small 5' and 3' additional sequences from the cDNAs, are amplified.

The purified and isolated cDNAs are digested into fragments of about 10-75 base pairs using restriction endonucleases and/or DNaseI, and the fragments of this desired size range are purified and isolated (e.g., by agarose gel electrophoresis, electroelution, and ethanol precipitation).

The purified and isolated fragments from the two or more VEGFs are mixed and subjected to a self-priming polymerase chain reaction to shuffle the fragments in order to form new hybrid molecules. Exemplary PCR protocols are set forth in Kikuchi et al. (1999) and Stemmer (1994). The annealing temperature in the PCR reactions is adjusted based on the level of sequence identity between the original cDNAs, to assure that annealing of heterologous sequences containing imperfect matches is possible. After conducting 25-50 cycles of PCR without primers, an aliquot from the PCR reaction is selected and used as template for a second round of PCR with primers based on 5' and 3' sequences of the original cDNAs. Preferably, the primers also include restriction endonuclease recognition sequences to facilitate cloning the resultant second-round PCR products into an expression vector.

The resultant clones are ligated into an expression vector and transformed or transected into host cells to express the novel hybrid VEGF polypeptides (if any) encoded thereby. The proteins are screened using receptor binding and/or activity assays as set forth in the preceding examples, to select those clones which encode polypeptides having desirable receptor agonist/antagonist profiles.

INDEX FOR SEQUENCE LISTING

SEQ ID NOS: 1 & 2 are the nucleotide and amino acid sequences of VEGF-A

SEQ ID NOS: 3-11 are VEGF-A forward primers

SEQ ID NOS: 12-20 are VEGF-A reverse primers

SEQ ID NOS: 21 & 22 are the nucleotide and amino acid sequences of VEGF-C

SEQ ID NOS: 23-31 are VEGF-C forward primers

SEQ ID NOS: 32-40 are VEGF-C reverse primers

SEQ ID NO: 41 is the nucleotide sequence of pSecTagI

SEQ ID NOS: 42 & 43 are the nucleotide and amino acid sequences of clone 11-1. The VEGF receptor binding domain (derived from VEGF-A and VEGF-C) correspond to amino acids 1-102 of SEQ ID NO: 43.

SEQ ID NOS: 44 & 45 are the nucleotide and amino acid sequences of clone 11-16. (VEGF receptor binding domain=amino acids 1-104 of SEQ ID NO: 45).

SEQ ID NOS: 46 & 47 are the nucleotide and amino acid sequences of clone 22-1. (VEGF receptor binding domain=amino acids 1-103 of SEQ ID NO: 47).

SEQ ID NOS: 48 & 49 are the nucleotide and amino acid sequences of clone 22-16. (VEGF receptor binding domain=amino acids 1-105 of SEQ ID NO: 49)

SEQ ID NOS: 50-51 are the nucleotide and amino acid sequences of clone 12-1. (VEGF receptor binding domain=amino acids 1-102 of SEQ ID NO: 51)

SEQ ID NOS: 52-53 are the nucleotide and amino acid sequences of clone 12-2. (VEGF receptor binding domain=amino acids 1-102 of SEQ ID NO: 53)

SEQ ID NOS: 54-55 are the nucleotide and amino acid sequences of clone 12-3. (VEGF receptor binding domain=amino acids 1-102 of SEQ ID NO: 55)

SEQ ID NOS: 56-57 are the nucleotide and amino acid sequences of clone 12-4. (VEGF receptor binding domain=amino acids 1-102 of SEQ ID NO: 57)

SEQ ID NOS: 58-59 are the nucleotide and amino acid sequences of clone 12-5. (VEGF receptor binding domain=amino acids 1-102 of SEQ ID NO: 59)

SEQ ID NOS: 60-61 are the nucleotide and amino acid sequences of clone 12-6. (VEGF receptor binding domain=amino acids 1-102 of SEQ ID NO: 61)

SEQ ID NOS: 62-63 are the nucleotide and amino acid sequences of clone 12-7. (VEGF receptor binding domain=amino acids 1-102 of SEQ ID NO: 63)

SEQ ID NOS: 64-65 are the nucleotide and amino acid sequences of clone 12-8. (VEGF receptor binding domain=amino acids 1-102 of SEQ ED NO: 65)

SEQ ID NOS: 66-67 are the nucleotide and amino acid sequences of clone 12-9. (VEGF receptor binding domain=amino acids 1-104 of SEQ ID NO: 67)

SEQ ID NOS: 68-69 are the nucleotide and amino acid sequences of clone 12-10. (VEGF receptor binding domain=amino acids 1-104 of SEQ ID NO: 69)

SEQ ID NOS: 70-71 are the nucleotide and amino acid sequences of clone 12-11. (VEGF receptor binding domain=amino acids 1-104 of SEQ ID NO: 71)

SEQ ID NOS: 72-73 are the nucleotide and amino acid sequences of clone 12-12. (VEGF receptor binding domain=amino acids 1-104 of SEQ ID NO: 73)

SEQ ID NOS: 74-75 are the nucleotide and amino acid sequences of clone 12-13. (VEGF receptor binding domain=amino acids 1-104 of SEQ ID NO: 75)

SEQ ID NOS: 76-77 are the nucleotide and amino acid sequences of clone 12-14. (VEGF receptor binding domain=amino acids 1-104 of SEQ ID NO: 77)

SEQ ID NOS: 78-79 are the nucleotide and amino acid sequences of clone 12-15. (VEGF receptor binding domain=amino acids 1-104 of SEQ ID NO: 79)

SEQ ID NOS: 80-81 are the nucleotide and amino acid sequences of clone 12-16. (VEGF receptor binding domain=amino acids 1-54 of SEQ ID NO: 81)

SEQ ID NOS: 82-83 are the nucleotide and amino acid sequences of clone 31-1 (VEGF receptor binding domain=amino acids 1-103 of SEQ ID NO: 83)

SEQ ID NOS: 84-85 are the nucleotide and amino acid sequences of clone 31-2 (VEGF receptor binding domain=amino acids 1-103 of SEQ ID NO: 85)

SEQ ID NOS: 86-87 are the nucleotide and amino acid sequences of clone 31-3 (VEGF receptor binding domain=amino acids 1-103 of SEQ ID NO: 87)

SEQ ID NOS: 88-89 are the nucleotide and amino acid sequences of clone 31-4 (VEGF receptor binding domain=amino acids 1-103 of SEQ ID NO: 89)

SEQ ID NOS: 90-91 are the nucleotide and amino acid sequences of clone 31-5 (VEGF receptor binding domain=amino acids 1-103 of SEQ ID NO: 91)

SEQ ID NOS: 92-93 are the nucleotide and amino acid sequences of clone 31-6 (VEGF receptor binding domain=amino acids 1-103 of SEQ ID NO: 93)

SEQ ID NOS: 94-95 are the nucleotide and amino acid sequences of clone 31-7 (VEGF receptor binding domain=amino acids 1-103 of SEQ ID NO: 95)

SEQ ID NOS: 96-97 are the nucleotide and amino acid sequences of clone 31-8 (VEGF receptor binding domain=amino acids 1-103 of SEQ ID NO: 97)

SEQ ID NOS: 98-99 are the nucleotide and amino acid sequences of clone 31-9 (VEGF receptor binding domain=amino acids 1-105 of SEQ ID NO: 99)

SEQ ID NOS: 100-101 are the nucleotide and amino acid sequences of clone 31-10 (VEGF receptor binding domain=amino acids 1-105 of SEQ ID NO: 101)

SEQ ID NOS: 102-103 are the nucleotide and amino acid sequences of clone 31-11 (VEGF receptor binding domain=amino acids 1-105 of SEQ ID NO: 103)

SEQ ID NOS: 104-105 are the nucleotide and amino acid sequences of clone 31-12 (VEGF receptor binding domain=amino acids 1-105 of SEQ ID NO: 105)

SEQ ID NOS: 106-107 are the nucleotide and amino acid sequences of clone 31-13 (VEGF receptor binding domain=amino acids 1-105 of SEQ ID NO: 107)

SEQ ID NOS: 108-109 are the nucleotide and amino acid sequences of clone 31-14 (VEGF receptor binding domain=amino acids 1-105 of SEQ ID NO: 109)

SEQ ID NOS: 110-111 are the nucleotide and amino acid sequences of clone 31-15 (VEGF receptor binding domain=amino acids 1-105 of SEQ ID NO: 111)

SEQ ID NOS: 112-113 are the nucleotide and amino acid sequences of clone 31-16 (VEGF receptor binding domain=amino acids 1-105 of SEQ ID NO: 113)

SEQ ID NOS: 114 & 115 are the nucleotide and amino acid sequences of PlGF

SEQ ID NOS: 116 & 117 are the nucleotide and amino acid sequences of VEGF-B

SEQ ID NOS: 118 & 119 are the nucleotide and amino acid sequences of VEGF-D

SEQ ID NOS: 120 & 121 are the nucleotide and amino acid sequences of VEGF-E

SEQ ID NOS: 122 & 123 are the nucleotide and amino acid sequences of NZ2 VEGF

SEQ ID NOS: 124 & 125 are the nucleotide and amino acid sequences of PDGF-A

SEQ ID NOS: 126 & 127 are the nucleotide and amino acid sequences of PDGF-B

SEQ ID NOS: 128-136 are the amino acid sequences of fragments A1-A9

SEQ ID NOS: 137-145 are the amino acid sequences of fragments C1-C9

SEQ ID NOS: 146 & 147 are the nucleotide and amino acid sequences of the 232 amino acid isoform of VEGF-A SEQ ID NOS: 148 & 149 are the nucleotide and amino acid sequences of fallotein SEQ ID NOS: 150 & 151 are the nucleotide and amino acid sequences D1701 VEGF SEQ ID NOS: 152 & 153 are the nucleotide and amino acid sequences of clone 14-9 (VEGF receptor binding domain amino acids 1-104 of SEQ ID NO: 153)

SEQ ID NOS: 154 & 155 are the nucleotide and amino acid sequences of clone 23-10 (VEGF receptor binding domain=amino acids 1-105 of SEQ ID NO: 155)

SEQ ID NOS: 156 & 157 are the nucleotide and amino acid sequences of clone 32-14 (VEGF receptor binding domain amino acids 1-105 of SEQ ID NO: 157)

SEQ ID NOS: 158 & 159 are the nucleotide and amino acid sequences of clone 52-15 (VEGF receptor binding domain=amino acids 1-105 of SEQ ID NO: 159)

SEQ ID NOS: 160 & 161 are the nucleotide and amino acid sequences of clone 53-3 (VEGF receptor binding domain amino acids 1-103 of SEQ ID NO: 161)

SEQ ID NOS: 162 & 163 are the nucleotide and amino acid sequences of clone 82-7 (VEGF receptor binding domain=amino acids 1-102 of SEQ ID NO: 163)

SEQ ID NOS: 164 & 165 are the nucleotide and amino acid sequences of clone 82-9 (VEGF receptor binding domain amino acids 1-104 of SEQ ID NO: 165)

SEQ ID NOS: 166 & 167 are the nucleotide and amino acid sequences of clone 82-11 (VEGF receptor binding domain=amino acids 1-104 of SEQ ID NO: 167)

SEQ ID NOS: 168 & 169 are the nucleotide and amino acid sequences of clone 82-13 (VEGF receptor binding domain=amino acids 1-104 of SEQ ID NO: 169)

SEQ ID NOS:170 & 171 are the nucleotide and amino acid sequences of clone 83-15 (VEGF receptor binding domain=amino acids 1-104 of SEQ ID NO: 171)

SEQ ID NOS: 172 & 173 are the nucleotide and amino acid sequences of clone 84-9 (VEGF receptor binding domain=amino acids 1-104 of SEQ ID NO: 173)

SEQ ID NOS: 174 & 175 are the nucleotide and amino acid sequences of clone 84-11 (VEGF receptor binding domain=amino acids 1-104 of SEQ ID NO: 175)

All publications and patents cited herein that are relevant to the description of the present invention are hereby incorporated by reference in their entirety.

While the present invention has been described in terms of specific embodiments, it is understood that variations and modifications will occur to those in the art. Accordingly, only such limitations as appear in the appended claims should be placed on the invention.

SEQ ID NOS: 176-1199 are indexed above in Example 1 in Table 2.5.

SEQ ID NO: 1200 is the sequence formula P-[PS]-C-V-X(3)-R-C-[GSTA]-G-C-C.

SEQ ID NO: 1201 is the sequence formula C-X(22-24)-P-[PSR]-C-V-X(3)-R-C-[GSTA]-G-C-C-X(6)-C-X(32-41)-C.

SEQ ID NO: 1202 is the sequence formula C-X(18-28)-P-X-C-X(4)-R-C-X-G-C(1-2)-X(6-12)-C-X(30-46)-C.

SEQ ID NO: 1203 is the sequence formula C-X(22-24)-P-[PSR]-C-V-X(3)-R-C-X-G-C-C-X(6)-C-X(32-41)-C.

SEQ ID NO: 1204 is the sequence formula TNTFxxxP.

SEQ ID NO: 1205 is the sequence EFGVATNTFFKPPCVSVYRCG.

SEQ ID NO: 1206 is the sequence TNTFFKPP.

SEQ ID NO: 1207 is the sequence formula TNTFFKPPCVxxxR.

SEQ ID NO: 1208 is the sequence formula TNTFFKPPCVxxxRCGGCC

SEQ ID NO: 1209 is a sequence of a VEGF region involved in VEGFR-1 binding.

SEQ ID NO: 1210 is a sequence of a VEGF-C region involved in VEGFR-3 binding.

SEQ ID NO: 1211 is the sequence formula IEYIxxxS

SEQ ID NO: 1212 is the sequence formula $TNTFX_nP$

SEQUENCE LISTING (1212 sequences)

SEQ ID NO: 1 - DNA, 990 bp, Homo sapiens
  CDS (57)..(629)
cagtgtgctggcggcccggcgcgagccggcccggccccggtcgggcctccgaaaccatgaactttctgctgtcttgggtgcattggagcctcgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacaccgcggccgccagcacactg

SEQ ID NO: 2 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 3 - DNA, 34 bp, Artificial Sequence
  Description of Artificial Sequence: Artificial chimeric oligonucleotide sequence derived from multiple vertebrate vascular endothelial growth factor
gatcctgggcagaatcatcacgaagtggtgaaat

SEQ ID NO: 4 - DNA, 32 bp, Artificial Sequence
  Description of Artificial Sequence: Artificial chimeric oligonucleotide sequence derived from multiple vertebrate vascular endothelial growth factor
tcatggatgtctatcagcgcagctactgccat

SEQ ID NO: 5 - DNA, 42 bp, Artificial Sequence
  Description of Artificial Sequence: Artificial chimeric oligonucleotide sequence derived from multiple vertebrate vascular endothelial growth factor
ccgatcgagacactggtggacatcttccaggaatagaagagc

SEQ ID NO: 6 - DNA, 33 bp, Artificial Sequence
  Description of Artificial Sequence: Artificial chimeric oligonucleotide sequence derived from multiple vertebrate vascular endothelial growth factor
cgctcttcgaataccctgatgagatcgagtaca

SEQ ID NO: 7 - DNA, 38 bp, Artificial Sequence
  Description of Artificial Sequence: Artificial chimeric oligonucleotide sequence derived from multiple vertebrate vascular endothelial growth factor
tcttcaagccatcctgcgtgcccctgatgagatgtggc

SEQ ID NO: 8 - DNA, 28 bp, Artificial Sequence
  Description of Artificial Sequence: Artificial chimeric oligonucleotide sequence derived from multiple vertebrate vascular endothelial growth factor
ccgggttgctgcaatgacgaagggctgg

SEQ ID NO: 9 - DNA, 46 bp, Artificial Sequence
  Description of Artificial Sequence: Artificial chimeric oligonucleotide sequence derived from multiple vertebrate vascular endothelial growth factor
agtgcgttcccaccgaggagtccaacatcaccatgcagattatgag

SEQ ID NO: 10 - DNA, 43 bp, Artificial Sequence
  Description of Artificial Sequence: Artificial chimeric oligonucleotide sequence derived from multiple vertebrate vascular endothelial growth factor
aattaaacctcaccaagggcagcacatcggagagatgagcttt

SEQ ID NO: 11 - DNA, 50 bp, Artificial Sequence
  Description of Artificial Sequence: Artificial chimeric oligonucleotide sequence derived from multiple vertebrate vascular endothelial growth factor
ctccagcataacaaatgtgaatgtagaccaaagaaagattgagtcttcgc

SEQ ID NO: 12 - DNA, 24 bp, Artificial Sequence
  Description of Artificial Sequence: Artificial chimeric oligonucleotide sequence derived from multiple vertebrate vascular endothelial growth factor
ccacttcgtgatgattctgcccag

SEQ ID NO: 13 - DNA, 42 bp, Artificial Sequence
  Description of Artificial Sequence: Artificial chimeric oligonucleotide sequence derived from multiple vertebrate vascular endothelial growth factor
tcggatggcagtagctgcgctgatagacatccatgaatttca

SEQ ID NO: 14 - DNA, 42 bp, Artificial Sequence
  Description of Artificial Sequence: Artificial chimeric oligonucleotide sequence derived from multiple vertebrate vascular endothelial growth factor
tcgagctcttctattcctggaagatgtccaccagtgtctcga

SEQ ID NO: 15 - DNA, 48 bp, Artificial Sequence
  Description of Artificial Sequence: Artificial chimeric oligonucleotide sequence derived from multiple vertebrate vascular endothelial growth factor
tggcttgaagatgtactcgatctcatcagggtattcgaagagcggtac

SEQ ID NO: 16 - DNA, 31 bp, Artificial Sequence
  Description of Artificial Sequence: Artificial chimeric oligonucleotide sequence derived from multiple vertebrate vascular endothelial growth factor
catggccacatctcatcaggggcacgcagga

SEQ ID NO: 17 - DNA, 37 bp, Artificial Sequence
  Description of Artificial Sequence: Artificial chimeric oligonucleotide sequence derived from multiple vertebrate vascular endothelial growth factor
gcactccagcccttcgtcattgcagcaacccgggtac

SEQ ID NO: 18 - DNA, 45 bp, Artificial Sequence
  Description of Artificial Sequence: Artificial chimeric oligonucleotide sequence derived from multiple vertebrate vascular endothelial growth factor
aattctcataatctgcatggtgatgttggactcctcggtgggaac

SEQ ID NO: 19 - DNA, 33 bp, Artificial Sequence
  Description of Artificial Sequence: Artificial chimeric oligonucleotide sequence derived from multiple vertebrate vascular endothelial growth factor
catctctccgatgtgctgcccttggtgaggttt

SEQ ID NO: 20 - DNA, 60 bp, Artificial Sequence
  Description of Artificial Sequence: Artificial chimeric oligonucleotide sequence derived from multiple vertebrate vascular endothelial growth factor
ggccgcgaagactcaatctttctttggtctacattcacatttgttatgctggagaaagct

SEQ ID NO: 21 - DNA, 1997 bp, Homo sapiens
  CDS (352)..(1608)
cccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattat

SEQ ID NO: 22 - protein, 419 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 23 - DNA, 34 bp, Artificial Sequence
  Description of Artificial Sequence: Artificial chimeric oligonucleotide sequence derived from multiple vertebrate vascular endothelial growth factor
gatcctgcacattataataccgagatcctgaaat

SEQ ID NO: 24 - DNA, 35 bp, Artificial Sequence
  Description of Artificial Sequence: Artificial chimeric oligonucleotide sequence derived from multiple vertebrate vascular endothelial growth factor
ctattgataatgagtggagaaagactcagtgcatg

SEQ ID NO: 25 - DNA, 42 bp, Artificial Sequence
  Description of Artificial Sequence: Artificial chimeric oligonucleotide sequence derived from multiple vertebrate vascular endothelial growth factor
ccgagagaggtgtgtatcgacgtggggaaggaatagaagagc

SEQ ID NO: 26 - DNA, 33 bp, Artificial Sequence
  Description of Artificial Sequence: Artificial chimeric oligonucleotide sequence derived from multiple vertebrate vascular endothelial growth factor
cgctcttcgaatttggagtcgcgacaaacacct

SEQ ID NO: 27 - DNA, 38 bp, Artificial Sequence
  Description of Artificial Sequence: Artificial chimeric oligonucleotide sequence derived from multiple vertebrate vascular endothelial growth factor
tcttcaagccaccatgtgtgtccgtgtacagatgtggc

SEQ ID NO: 28 - DNA, 28 bp, Artificial Sequence
  Description of Artificial Sequence: Artificial chimeric oligonucleotide sequence derived from multiple vertebrate vascular endothelial growth factor
ccgggttgctgcaatagtgaggggctgc

SEQ ID NO: 29 - DNA, 46 bp, Artificial Sequence
  Description of Artificial Sequence: Artificial chimeric oligonucleotide sequence derived from multiple vertebrate vascular endothelial growth factor
agtgcatgaacacgtccacgagctacctcagcaagacgctgtttga

SEQ ID NO: 30 - DNA, 49 bp, Artificial Sequence
  Description of Artificial Sequence: Artificial chimeric oligonucleotide sequence derived from multiple vertebrate vascular endothelial growth factor
aattacagtgcctctctctcaagggcccaaaccagtgacaatcagcttt

SEQ ID NO: 31 - DNA, 50 bp, Artificial Sequence
  Description of Artificial Sequence: Artificial chimeric oligonucleotide sequence derived from multiple vertebrate vascular endothelial growth factor
gccaatcacacttcctgccgatgcatgtctaagctggattgagtcttcgc

SEQ ID NO: 32 - DNA, 24 bp, Artificial Sequence
  Description of Artificial Sequence: Artificial chimeric oligonucleotide sequence derived from multiple vertebrate vascular endothelial growth factor
ggatctcggtattataatgtgcag

SEQ ID NO: 33 - DNA, 45 bp, Artificial Sequence
  Description of Artificial Sequence: Artificial chimeric oligonucleotide sequence derived from multiple vertebrate vascular endothelial growth factor
tcggcatgcactgagtctttctccactcattatcaatagatttca

SEQ ID NO: 34 - DNA, 42 bp, Artificial Sequence
  Description of Artificial Sequence: Artificial chimeric oligonucleotide sequence derived from multiple vertebrate vascular endothelial growth factor
tcgagctcttctattccttccccacgtcgatacacacctctc

SEQ ID NO: 35 - DNA, 48 bp, Artificial Sequence
  Description of Artificial Sequence: Artificial chimeric oligonucleotide sequence derived from multiple vertebrate vascular endothelial growth factor
tggcttgaagaaggtgtttgtcgcgactccaaattcgaagagcggtac

SEQ ID NO: 36 - DNA, 31 bp, Artificial Sequence
  Description of Artificial Sequence: Artificial chimeric oligonucleotide sequence derived from multiple vertebrate vascular endothelial growth factor
catggccacatctgtacacggacacacatgg

SEQ ID NO: 37 - DNA, 37 bp, Artificial Sequence
  Description of Artificial Sequence: Artificial chimeric oligonucleotide sequence derived from multiple vertebrate vascular endothelial growth factor
gcactgcagcccctcactattgcagcaacccgggtac

SEQ ID NO: 38 - DNA, 45 bp, Artificial Sequence
  Description of Artificial Sequence: Artificial chimeric oligonucleotide sequence derived from multiple vertebrate vascular endothelial growth factor
aatttcaaacagcgtcttgctgaggtagctcgtggacgtgttcat

SEQ ID NO: 39 - DNA, 39 bp, Artificial Sequence
  Description of Artificial Sequence: Artificial chimeric oligonucleotide sequence derived from multiple vertebrate vascular endothelial growth factor
gattgtcactggtttgggcccttgagagagaggcactgt

SEQ ID NO: 40 - DNA, 60 bp, Artificial Sequence
  Description of Artificial Sequence: Artificial chimeric oligonucleotide sequence derived from multiple vertebrate vascular endothelial growth factor
ggccgcgaagactcaatccagcttagacatgcatcggcaggaagtgtgattggcaaagct

SEQ ID NO: 41 - DNA, 5070 bp, Artificial Sequence
  Description of Artificial Sequence: pSecTagI Vector
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcggcggtgttgacaattaatcatcggcatagtatatcggcatagtataatacgacaaggtgaggaactaaaccatggagacagacacactcctgctatgggtactgctgctctgggttccaggttccactggtgacgcggcccaggatccgtctcccatgccgatttggtcttcgaacaaaaactcatctcagaagaggatctgaatagcgccgtcgaccatcatcatcatcatcattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagataatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggctaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 42 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 43 - protein, 126 aa, Artificial Sequence
  Growth Factor Hybrid Sequence
GQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDLVFEQKLISEEDLNSAVDHHHHHH

SEQ ID NO: 44 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 45 - protein, 128 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCMNTSTSYLSKTLFEITVPLSQGPKPVTISFANHTSCRCMSKLDLVFEQKLISEEDLNSAVDHHHHHH

SEQ ID NO: 46 - DNA, 391 bp, Artificial Sequence
  Growth Factor Hybrid Sequence
  CDS (8)..(388)
ggatcctgcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 47 - protein, 127 aa, Artificial Sequence
  Growth Factor Hybrid Sequence
AHYNTEILKSIDNEWRKTQCMPREVCIDVGKEFGVATNTFFKPPCVSVYRCGGCCNDEGLECVPTEESNITMQIMRIKPHQGQHIGEMSFLQHNKCECRPKKDLVFEQKLISEEDLNSAVDHHHHHH

SEQ ID NO: 48 - DNA, 397 bp, Artificial Sequence
  Growth Factor Hybrid Sequence
  CDS (8)..(394)
ggatcctgcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 49 - protein, 129 aa, Artificial Sequence
  Growth Factor Hybrid Sequence
AHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDLVFEQKLISEEDLNSAVDHHHHHH

SEQ ID NO: 50 - DNA, 322 bp, Artificial Sequence
  Growth Factor Hybrid Sequence
  CDS (8)..(322)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagatttggtcttc

SEQ ID NO: 51 - protein, 105 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRIKPHQGQHIGEMSFLQHNKCECRPKKDLVF

SEQ ID NO: 52 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 53 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEIKPHQGQHIGEMSFLQHNKCECRPKKDLVFEQKLISEEDLNSAVDHHHHHH

SEQ ID NO: 54 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 55 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRIKPHQGQHIGEMSFLQHNKCECRPKKDLVFEQKLISEEDLNSAVDHHHHHH

SEQ ID NO: 56 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 57 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEIKPHQGQHIGEMSFLQHNKCECRPKKDLVFEQKLISEEDLNSAVDHHHHHH

SEQ ID NO: 58 - DNA, 322 bp, Artificial Sequence
  Growth Factor Hybrid Sequence
  CDS (8)..(322)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggatttggtcttc

SEQ ID NO: 59 - protein, 105 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRIKPHQGQHIGEMSFANHTSCRCMSKLDLVF

SEQ ID NO: 60 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 61 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEIKPHQGQHIGEMSFANHTSCRCMSKLDLVFEQKLISEEDLNSAVDHHHHHH

SEQ ID NO: 62 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 63 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRIKPHQGQHIGEMSFANHTSCRCMSKLDLVFEQKLISEEDLNSAVDHHHHHH

SEQ ID NO: 64 - DNA, 388 bp, Artificial Sequence
  Growth Factor Hybrid Sequence
  CDS (8)..(385)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 65 - protein, 126 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEIKPHQGQHIGEMSFANHTSCRCMSKLDLVFEQKLISEEDLNSAVDHHHHHH

SEQ ID NO: 66 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 67 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRITVPLSQGPKPVTISFLQHNKCECRPKKDLVFEQKLISEEDLNSAVDHHHHHH

SEQ ID NO: 68 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 69 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEITVPLSQGPKPVTISFLQHNKCECRPKKDLVFEQKLISEEDLNSAVDHHHHHH

SEQ ID NO: 70 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 71 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRITVPLSQGPKPVTISFLQHNKCECRPKKDLVFEQKLISEEDLNSAVDHHHHHH

SEQ ID NO: 72 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 73 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEITVPLSQGPKPVTISFLQHNKCECRPKKDLVFEQKLISEEDLNSAVDHHHHHH

SEQ ID NO: 74 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctgaatttggtcttcgaacaaaaactcatctcagaagaggatctgaatagcgccgtcgaccatcatcatcatcatcattga

SEQ ID NO: 75 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRITVPLSQGPKPVTISFANHTSCRCMSKLNLVFEQKLISEEDLNSAVDHHHHHH

SEQ ID NO: 76 - DNA, 328 bp, Artificial Sequence
  Growth Factor Hybrid Sequence
  CDS (8)..(322)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttc

SEQ ID NO: 77 - protein, 105 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEITVPLSQGPKPVTISFANHTSCRCMSKLDL

SEQ ID NO: 78 - DNA, 394 bp, Artificial Sequence
  Growth Factor Hybrid Sequence
  CDS (8)..(391)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 79 - protein, 128 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRITVPLSQGPKPVTISFANHTSCRCMSKLDLVFEQKLISEEDLNSAVDHHHHHH

SEQ ID NO: 80 - DNA, 392 bp, Artificial Sequence
  Growth Factor Hybrid Sequence
  CDS (8)..(169)
ggatcctgggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 81 - protein, 54 aa, Artificial Sequence
  Growth Factor Hybrid Sequence
GQNHHEVVKFMDVYQRSYCHPIETLVDIFQEFGVATNTFFKPPCVSVYRCGLLQ

SEQ ID NO: 82 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 83 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRIKPHQGQHIGEMSFLQHNKCECRPKKDLVFEQKLISEEDLNSAVDHHHHHH

SEQ ID NO: 84 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 85 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEIKPHQGQHIGEMSFLQHNKCECRPKKDLVFEQKLISEEDLNSAVDHHHHHH

SEQ ID NO: 86 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 87 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRIKPHQGQHIGEMSFLQHNKCECRPKKDLVFEQKLISEEDLNSAVDHHHHHH

SEQ ID NO: 88 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 89 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEIKPHQGQHIGEMSFLQHNKCECRPKKDLVFEQKLISEEDLNSAVDHHHHHH

SEQ ID NO: 90 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 91 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRIKPHQGQHIGEMSFANHTSCRCMSKLDLVFEQKLISEEDLNSAVDHHHHHH

SEQ ID NO: 92 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 93 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEIKPHQGQHIGEMSFANHTSCRCMSKLDLVFEQKLISEEDLNSAVDHHHHHH

SEQ ID NO: 94 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 95 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRIKPHQGQHIGEMSFANHTSCRCMSKLDLVFEQKLISEEDLNSAVDHHHHHH

SEQ ID NO: 96 - DNA, 391 bp, Artificial Sequence
  Growth Factor Hybrid Sequence
  CDS (8)..(388)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggatttggtcttcgaacaaaaactcatctcagaagaggatctgaatagcgccgtcgaccatcatcatcatcatcattga

SEQ ID NO: 97 - protein, 127 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEIKPHQGQHIGEMSFANHTSCRCMSKLDLVFEQKLISEEDLNSAVDHHHHHH

SEQ ID NO: 98 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 99 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRITVPLSQGPKPVTISFLQHNKCECRPKKDLVFEQKLISEEDLNSAVDHHHHHH

SEQ ID NO: 100 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 101 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEITVPLSQGPKPVTISFLQHNKCECRPKKDLVFEQKLISEEDLNSAVDHHHHHH

SEQ ID NO: 102 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 103 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRITVPLSQGPKPVTISFLQHNKCECRPKKDLVFEQKLISEEDLNSAVDHHHHHH

SEQ ID NO: 104 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagatttggtcttcgaacaaaaactcatctcagaagaggatctgaatagcgccgtcgaccatcatcatcatcatcattga

SEQ ID NO: 105 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEITVPLSQGPKPVTISFLQHNKCECRPKKDLVFEQKLISEEDLNSAVDHHHHHH

SEQ ID NO: 106 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 107 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRITVPLSQGPKPVTISFANHTSCRCMSKLDLVFEQKLISEEDLNSAVDHHHHHH

SEQ ID NO: 108 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 109 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEITVPLSQGPKPVTISFANHTSCRCMSKLDLVFEQKLISEEDLNSAVDHHHHHH

SEQ ID NO: 110 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 111 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRITVPLSQGPKPVTISFANHTSCRCMSKLDLVFEQKLISEEDLNSAVDHHHHHH

SEQ ID NO: 112 - DNA, 397 bp, Artificial Sequence
  Growth Factor Hybrid Sequence
  CDS (8)..(394)
ggatcctgggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttcgaacaaaaactcatctcagaagaggatctgaatagcgccgtcgaccatcatcatcatcatcattga

SEQ ID NO: 113 - protein, 129 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEITVPLSQGPKPVTISFANHTSCRCMSKLDLVFEQKLISEEDLNSAVDHHHHHH

SEQ ID NO: 114 - DNA, 1645 bp, Homo sapiens
  CDS (322)..(768)
gggattcgggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggattctgctggggccgccacggcctggtggtgggaaggccggcagcgggcggaggggattcagccacttccccctcttcttctgaagatcagaacattcagctctggagaacagtggttgcctgggggcttttgccactccttgtcccccgtgatctcccctcacactttgccatttgcttgtactgggacattgttctttccggccgaggtgccaccaccctgcccccactaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaacgc

SEQ ID NO: 115 - protein, 149 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 116 - DNA, 570 bp, Homo sapiens
  CDS (4)..(570)
accatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtga

SEQ ID NO: 117 - protein, 188 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 118 - DNA, 2029 bp, Homo sapiens
  CDS (411)..(1472)
gttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccaaaaaaaaaaaaaaaaaa

SEQ ID NO: 119 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 120 - DNA, 1830 bp, Orf virus
  CDS (312)..(755)
cggccacgcggccgcgaactgcgcgctcgcgcgcgtggcgaccgcgctgacgcgccgcgtgcccgcgagccggcacggcctcgcggagggcggcacgccgccgtggacgctgctgctggcggtggccgcggtggcggtgctcggcgtggtggcaatttcgctgctgcgccgcgcgctaagaatacggtttagatactcaaagtctatccagacacttagagtgtaactttgagtaaaaaatgtaaatactaacgccaaaatttcgatagttgttaagcaatatataacatttttaaaacgtcatcaccagcatgaagttaacagctacgttacaagttgttgttgcattgttaatatgtatgtataatttgccagaatgcgtgtctcagagtaatgattcacctccttcaaccaatgactggatgcgtacactagacaaaagtggttgtaaacctagagatactgttgtttatttgggagaagaatatccagaaagcactaacctacaatataatccccggtgcgtaactgttaaacgatgcagtggttgctgtaacggtgacggtcaaatatgtacagcggttgaaacaagaaatacaactgtaacagtttcagtaaccggcgtgtctagttcgtctggtactaatagtggtgtatctactaaccttcaaagaataagtgttacagaacacacaaagtgcgattgtattggtagaacaacgacaacacctacgaccactagggaacctagacgataactaataacaaaaaatgtttatttttgtaaatacttaattattacacactttacaataatctcaaaaataaattgcgtgcccggacggctgcagctggtgacgctgctgtgtcacacactgcgtattcgattcaagttcactaacgccactaaactagttgtgcgtgtccgagtgttaaccgtacgtcaaactaacatcttacctgtccgtgacaagaactaaaacttgaaccacatatttttaaagtatatttaacaaaatcactcacactcacacaatcataaacaccacaaccacaaccaaacacgcatgagaattaatattcttacttatccgtaacactctatgctgtacatcaacgcatcagagcagtctgagtctgactaatggcggcaaacgggaacgcaggcgcgacataatcactgagaatctccgcagcaaccgctcaaggacatctctagcgctaacggctgtttgtcattcccccgtgtgttcatctcacacgacattgtgaccgtcgcaaagcacacattcaaagtgccgcatgtggaagaattcaccgtcgagacacacaccataattaaacaagatcagtgcataagagagattagcattctacagcacaccacgtgcgaatacggacctcgtaattgtttagactagaacacctctggtctaaacaacatgtccgatcttagaacagagtttatgacgcatatgtaactgtgttctttatgtagaagttatcttttatgtcactcccttgtcttagatgagttatacatgacatgatgtatgtgtcgcccgcggcggcgcggggcgctcggcggcggggctgctgcgcgcggcgggcccgcggtggcggcggctggcgcggcgctgcggccgcgggcgcgcggcggggtagcggcccgcccgcccgggcgcccgccgcagcccttgccccggaccaggcgccacggagcaaagtgaaaaaggaccgcctagcagtcgagaccctcccgccgcagccgcgacaccccacacccgccttccacccgccagacgccaacaccacagccaacaagcatgc

SEQ ID NO: 121 - protein, 148 aa, Orf virus
MKLTATLQVVVALLICMYNLPECVSQSNDSPPSTNDWMRTLDKSGCKPRDTVVYLGEEYPESTNLQYNPRCVTVKRCSGCCNGDGQICTAVETRNTTVTVSVTGVSSSSGTNSGVSTNLQRISVTEHTKCDCIGRTTTTPTTTREPRR

SEQ ID NO: 122 - DNA, 851 bp, Orf virus
  CDS (2)..(223)
cggccacgcggccgcgaactgcgcgctcgcgcgcgtggcgaccgcgctgacgcgccgcgtgcccgcgagccggcacggcctcgcggagggcggcacgccgccgtggacgctgctgctggcggtggccgcggtgacggtgctcggcgtggtggcggtttcactgctgcggcgcgcgctgcgggtacgctaccgcttcgcgcggccggccgcgctgcgcgcgtagccgcgcaaaatgtaaattataacgcccaacttttaagggtgaggcgccatgaagttgctcgtcggcatactagtagccgtgtgcttgcaccagtatctgctgaacgcggacagcaacacgaaaggatggtccgaagtgctgaaaggcagcgagtgcaagcctaggccgattgttgttcctgtaagcgagacgcacccagagctgacttctcagcggttcaacccgccgtgtgtcacgttgatgcgatgcggcgggtgctgcaacgacgagagcttggaatgcgtccccacggaagaagtaaacgtgagcatggaactcctgggggcgtcgggctccggtagtaacgggatgcaacgtctgagcttcgtagagcataagaaatgcgattgtagaccacgattcacaaccacgccaccgacgaccacaaggccgcccagaagacgccgctagaactttttatggaccgcagatccaaacgatggatgcgatcaggtacatgcggaagaaggcgccacggagcaaagtgaaaaaggaccgcctagcagtcgagaccctcccgccgcagccgcggacaccccacacccgccttccacccgccagacgccaacaccgcagccaacaagcatgc

SEQ ID NO: 123 - protein, 73 aa, Orf virus
GHAAANCALARVATALTRRVPASRHGLAEGGTPPWTLLLAVAAVTVLGVVAVSLLRRALRVRYRFARPAALRA

SEQ ID NO: 124 - DNA, 2305 bp, Homo sapiens
  CDS (404)..(991)
ttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccggctgcggcgcgcactccctgtttctcctcctcctggctggcgctgcctgcctctccgcactcactgctcgccgggcgccgtccgccagctccgtgctccccgcgccaccctcctccgggccgcgctccctaagggatggtactgaatttcgccgccacaggagaccggctggagcgcccgccccgcgcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccacgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcagggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttttttacaccataaagtgattattaagcttccttttactctttggctagctttttttttttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttcttcttttgttgatccaaaattaaaaaaaaaataccaccaac

SEQ ID NO: 125 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 126 - DNA, 2137 bp, Homo sapiens
  CDS (983)..(1705)
ccctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggcccgccgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctgcactcgggctcgggatccgcccaggtagcggcctcggacccaggtcctgcgcccaggtcctcccctgccccccagcgacggagccggggccgggggcggcggcgccgggggcatgcgggtgagccgcggctgcagaggcctgagcgcctgatcgccgcggacccgagccgagcccacccccctccccagccccccaccctggccgcgggggcggcgcgctcgatctacgcgttcggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggccttggagtagataatattgtttccctcgtccgtctgtctcgatgcctgattcggacggccaatggtgcctcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggttccttcccctgcacctggcctgggccacacctgagcgctgtggactgtcctgaggagccctgaggacctctcagcatagcctgcctgatccctgaaccc

SEQ ID NO: 127 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 128 - protein, 11 aa, Artificial Sequence
  Description of Artificial Sequence: synthetic peptide
DPGQNHHEVVK

SEQ ID NO: 129 - protein, 11 aa, Artificial Sequence
  Description of Artificial Sequence: synthetic peptide
FMDVYQRSYCH

SEQ ID NO: 130 - protein, 10 aa, Artificial Sequence
  Description of Artificial Sequence: synthetic peptide
PIETLVDIFQ

SEQ ID NO: 131 - protein, 8 aa, Artificial Sequence
  Description of Artificial Sequence: synthetic peptide
EYPDEIEY

SEQ ID NO: 132 - protein, 13 aa, Artificial Sequence
  Description of Artificial Sequence: synthetic peptide
IFKPSCVPLMRCG

SEQ ID NO: 133 - protein, 8 aa, Artificial Sequence
  Description of Artificial Sequence: synthetic peptide
GCCNDEGL

SEQ ID NO: 134 - protein, 16 aa, Artificial Sequence
  Description of Artificial Sequence: synthetic peptide
ECVPTEESNITMQIMR

SEQ ID NO: 135 - protein, 14 aa, Artificial Sequence
  Description of Artificial Sequence: synthetic peptide
IKPHQGQHIGEMSF

SEQ ID NO: 136 - protein, 13 aa, Artificial Sequence
  Description of Artificial Sequence: synthetic peptide
LQHNKCECRPKKD

SEQ ID NO: 137 - protein, 11 aa, Artificial Sequence
  Description of Artificial Sequence: synthetic peptide
DPAHYNTEILK

SEQ ID NO: 138 - protein, 12 aa, Artificial Sequence
  Description of Artificial Sequence: synthetic peptide
SIDNEWRKTQCM

SEQ ID NO: 139 - protein, 10 aa, Artificial Sequence
  Description of Artificial Sequence: synthetic peptide
PREVCIDVGK

SEQ ID NO: 140 - protein, 8 aa, Artificial Sequence
  Description of Artificial Sequence: synthetic peptide
EFGVATNT

SEQ ID NO: 141 - protein, 13 aa, Artificial Sequence
  Description of Artificial Sequence: synthetic peptide
FFKPPCVSVYRCG

SEQ ID NO: 142 - protein, 8 aa, Artificial Sequence
  Description of Artificial Sequence: synthetic peptide
GCCNSEGL

SEQ ID NO: 143 - protein, 16 aa, Artificial Sequence
  Description of Artificial Sequence: synthetic peptide
QCMNTSTSYLSKTLFE

SEQ ID NO: 144 - protein, 16 aa, Artificial Sequence
  Description of Artificial Sequence: synthetic peptide
ITVPLSQGPKPVTISF

SEQ ID NO: 145 - protein, 13 aa, Artificial Sequence
  Description of Artificial Sequence: synthetic peptide
ANHTSCRCMSKLD

SEQ ID NO: 146 - DNA, 815 bp, Homo sapiens
  CDS (69)..(767)
gaattcgaattccagtgtgctggcggccgcgcgcgagccgcgccggccccggtcgggcctccgaaaccatgaactttctgctgtcttgggtgcattggagcctcgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggctggaggaaggagcctccctcagggtttcgggaaccagatcc

SEQ ID NO: 147 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 148 - DNA, 3007 bp, Homo sapiens
  CDS (492)..(1529)
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaatt

SEQ ID NO: 149 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 150 - DNA, 399 bp, Orf virus
  CDS (1)..(399)
atgaagtttctcgtcggcatactggtagctgtgtgcttgcaccagtatctgctgaacgcggacagcacgaaaacatggtccgaagtgtttgaaaacagcgggtgcaagccaaggccgatggtctttcgagtacacgacgagcacccggagctaacttctcagcggttcaacccgccgtgtgtcacgttgatgcgatgcggcgggtgctgcaacgacgagagcttagaatgcgtccccacggaagaggcaaacgtaacgatgcaactcatgggagcgtcggtctccggtggtaacgggatgcaacatctgagcttcgtagagcataagaaatgcgattgtaaaccaccactcacgaccacgccaccgacgaccacaaggccgcccagaagacgccgctag

SEQ ID NO: 151 - protein, 132 aa, Orf virus
MKFLVGILVAVCLHQYLLNADSTKTWSEVFENSGCKPRPMVFRVHDEHPELTSQRFNPPCVTLMRCGGCCNDESLECVPTEEANVTMQLMGASVSGGNGMQHLSFVEHKKCDCKPPLTTTPPTTTRPPRRRR

SEQ ID NO: 152 - DNA, 328 bp, Artificial Sequence
  Growth Factor Hybrid Sequence
  CDS (8)..(322)
ggatcctgggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttc

SEQ ID NO: 153 - protein, 105 aa, Artificial Sequence
  Growth Factor Hybrid Sequence
GQNHHEVVKFMDVYQRSYCHPIETLVDIFQEFGVATNTFFKPSCVPLMRCGGCCNDEGLECVPTEESNITMQIMRITVPLSQGPKPVTISFLQHNKCECRPKKDL

SEQ ID NO: 154 - DNA, 331 bp, Artificial Sequence
  Growth Factor Hybrid Sequence
  CDS (8)..(322)
ggatcctgcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagatttggtcttc

SEQ ID NO: 155 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNDEGLECMNTSTSYLSKTLFEITVPLSQGPKPVTISFLQHNKCECRPKKD

SEQ ID NO: 156 - DNA, 331 bp, Artificial Sequence
  Growth Factor Hybrid Sequence
  CDS (8)..(322)
ggatcctgggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggatttggtcttc

SEQ ID NO: 157 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNDEGLECMNTSTSYLSKTLFEITVPLSQGPKPVTISFANHTSCRCMSKLD

SEQ ID NO: 158 - DNA, 331 bp, Artificial Sequence
  Growth Factor Hybrid Sequence
  CDS (8)..(322)
ggatcctgcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttc

SEQ ID NO: 159 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNSEGLQCVPTEESNITMQIMRITVPLSQGPKPVTISFANHTSCRCMSKLD

SEQ ID NO: 160 - DNA, 325 bp, Artificial Sequence
  Growth Factor Hybrid Sequence
  CDS (8)..(322)
ggatcctgcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagatttggtcttc

SEQ ID NO: 161 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCVPTEESNITMQIMRIKPHQGQHIGEMSFLQHNKCECRPKKDLV

SEQ ID NO: 162 - DNA, 322 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggatttggtcttc

SEQ ID NO: 163 - protein, 105 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRIKPHQGQHIGEMSFANHTSCRCMSKLDLVF

SEQ ID NO: 164 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttc

SEQ ID NO: 165 - protein, 105 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRITVPLSQGPKPVTISFLQHNKCECRPKKDL

SEQ ID NO: 166 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttc

SEQ ID NO: 167 - protein, 105 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRITVPLSQGPKPVTISFLQHNKCECRPKKDL

SEQ ID NO: 168 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttc

SEQ ID NO: 169 - protein, 105 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRITVPLSQGPKPVTISFANHTSCRCMSKLDL

SEQ ID NO: 170 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggatttggtcttc

SEQ ID NO: 171 - protein, 105 aa, Artificial Sequence
  Growth Factor Hybrid Sequence
AHYNTEILKFMDVYQRSYCHPIETLVDIFQEYPDEIEYIFKPPCVSVYRCGGCCNSEGLQCVPTEESNITMQIMRITVPLSQGPKPVTISFANHTSCRCMSKLDL

SEQ ID NO: 172 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttc

SEQ ID NO: 173 - protein, 105 aa, Artificial Sequence
  Growth Factor Hybrid Sequence
AHYNTEILKFMDVYQRSYCHPIETLVDIFQEFGVATNTFFKPSCVPLMRCGGCCNDEGLECVPTEESNITMQIMRITVPLSQGPKPVTISFLQHNKCECRPKKDL

SEQ ID NO: 174 - DNA, 328 bp, Artificial Sequence
  Growth Factor Hybrid Sequence
  CDS (8)..(322)
ggatcctgcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagatttggtcttc

SEQ ID NO: 175 - protein, 105 aa, Artificial Sequence
  Growth Factor Hybrid Sequence
AHYNTEILKFMDVYQRSYCHPIETLVDIFQEFGVATNTFFKPSCVPLMRCGGCCNSEGLQCVPTEESNITMQIMRITVPLSQGPKPVTISFLQHNKCECRPKKDL

SEQ ID NO: 176 - DNA, 306 bp, Homo sapiens
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 177 - protein, 102 aa, Homo sapiens [sequence omitted]

SEQ ID NO: 178 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 179 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNDEGLECVPTEESNITMQIMRIKPHQGQHIGEMSFLQHNKCECRPKKD

SEQ ID NO: 180 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 181 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRIKPHQGQHIGEMSFLQHNKCECRPKKD

SEQ ID NO: 182 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 183 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNDEGLECVPTEESNITMQIMRIKPHQGQHIGEMSFLQHNKCECRPKKD

SEQ ID NO: 184 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 185 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNDEGLECVPTEESNITMQIMRIKPHQGQHIGEMSFLQHNKCECRPKKD

SEQ ID NO: 186 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 187 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNDEGLECVPTEESNITMQIMRIKPHQGQHIGEMSFLQHNKCECRPKKD

SEQ ID NO: 188 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 189 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECVPTEESNITMQIMRIKPHQGQHIGEMSFLQHNKCECRPKKD

SEQ ID NO: 190 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 191 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNDEGLECVPTEESNITMQIMRIKPHQGQHIGEMSFLQHNKCECRPKKD

SEQ ID NO: 192 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 193 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNDEGLECVPTEESNITMQIMRIKPHQGQHIGEMSFLQHNKCECRPKKD

SEQ ID NO: 194 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 195 - protein, 102 aa, Artificial Sequence
  Growth Factor Hybrid Sequence
AHYNTEILKFMDVYQRSYCHPIETLVDIFQEFGVATNTFFKPSCVPLMRCGGCCNDEGLECVPTEESNITMQIMRIKPHQGQHIGEMSFLQHNKCECRPKKD

SEQ ID NO: 196 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 197 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNDEGLECVPTEESNITMQIMRIKPHQGQHIGEMSFLQHNKCECRPKKD

SEQ ID NO: 198 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 199 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNDEGLECVPTEESNITMQIMRIKPHQGQHIGEMSFLQHNKCECRPKKD

SEQ ID NO: 200 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 201 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNDEGLECVPTEESNITMQIMRIKPHQGQHIGEMSFLQHNKCECRPKKD

SEQ ID NO: 202 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 203 - protein, 102 aa, Artificial Sequence
  Growth Factor Hybrid Sequence
AHYNTEILKFMDVYQRSYCHPREVCIDVGKEFGVATNTFFKPSCVPLMRCGGCCNDEGLECVPTEESNITMQIMRIKPHQGQHIGEMSFLQHNKCECRPKKD

SEQ ID NO: 204 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 205 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNDEGLECVPTEESNITMQIMRIKPHQGQHIGEMSFLQHNKCECRPKKD

SEQ ID NO: 206 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 207 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNDEGLECVPTEESNITMQIMRIKPHQGQHIGEMSFLQHNKCECRPKKD

SEQ ID NO: 208 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 209 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNDEGLECVPTEESNITMQIMRIKPHQGQHIGEMSFLQHNKCECRPKKD

SEQ ID NO: 210 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 211 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNDEGLECVPTEESNITMQIMRIKPHQGQHIGEMSFLQHNKCECRPKKD

SEQ ID NO: 212 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 213 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECVPTEESNITMQIMRIKPHQGQHIGEMSFLQHNKCECRPKKD

SEQ ID NO: 214 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 215 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNDEGLECVPTEESNITMQIMRIKPHQGQHIGEMSFLQHNKCECRPKKD

SEQ ID NO: 216 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 217 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNDEGLECVPTEESNITMQIMRIKPHQGQHIGEMSFLQHNKCECRPKKD

SEQ ID NO: 218 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 219 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNDEGLECVPTEESNITMQIMRIKPHQGQHIGEMSFLQHNKCECRPKKD

SEQ ID NO: 220 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 221 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECVPTEESNITMQIMRIKPHQGQHIGEMSFLQHNKCECRPKKD

SEQ ID NO: 222 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 223 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNDEGLECVPTEESNITMQIMRIKPHQGQHIGEMSFLQHNKCECRPKKD

SEQ ID NO: 224 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 225 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRIKPHQGQHIGEMSFLQHNKCECRPKKD

SEQ ID NO: 226 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 227 - protein, 102 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRIKPHQGQHIGEMSFLQHNKCECRPKKD

SEQ ID NO: 228 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 229 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNDEGLECVPTEESNITMQIMRIKPHQGQHIGEMSFLQHNKCECRPKKD

SEQ ID NO: 230 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 231 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNDEGLECVPTEESNITMQIMRIKPHQGQHIGEMSFLQHNKCECRPKKD

SEQ ID NO: 232 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 233 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNDEGLECVPTEESNITMQIMRIKPHQGQHIGEMSFLQHNKCECRPKKD

SEQ ID NO: 234 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 235 - protein, 102 aa, Artificial Sequence
  Growth Factor Hybrid Sequence
AHYNTEILKFMDVYQRSYCHPREVCIDVGKEFGVATNTFFKPPCVSVYRCGGCCNDEGLECVPTEESNITMQIMRIKPHQGQHIGEMSFLQHNKCECRPKKD

SEQ ID NO: 236 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 237 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNDEGLECVPTEESNITMQIMRIKPHQGQHIGEMSFLQHNKCECRPKKD

SEQ ID NO: 238 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 239 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNDEGLECVPTEESNITMQIMRIKPHQGQHIGEMSFLQHNKCECRPKKD

SEQ ID NO: 240 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 241 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCVPTEESNITMQIMRIKPHQGQHIGEMSFLQHNKCECRPKKD

SEQ ID NO: 242 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 243 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNSEGLQCVPTEESNITMQIMRIKPHQGQHIGEMSFLQHNKCECRPKKD

SEQ ID NO: 244 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 245 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRIKPHQGQHIGEMSFLQHNKCECRPKKD

SEQ ID NO: 246 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 247 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCVPTEESNITMQIMRIKPHQGQHIGEMSFLQHNKCECRPKKD

SEQ ID NO: 248 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 249 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCVPTEESNITMQIMRIKPHQGQHIGEMSFLQHNKCECRPKKD

SEQ ID NO: 250 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 251 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNSEGLQCVPTEESNITMQIMRIKPHQGQHIGEMSFLQHNKCECRPKKD

SEQ ID NO: 252 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 253 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCVPTEESNITMQIMRIKPHQGQHIGEMSFLQHNKCECRPKKD

SEQ ID NO: 254 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 255 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCVPTEESNITMQIMRIKPHQGQHIGEMSFLQHNKCECRPKKD

SEQ ID NO: 256 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 257 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNSEGLQCVPTEESNITMQIMRIKPHQGQHIGEMSFLQHNKCECRPKKD

SEQ ID NO: 258 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 259 - protein, 102 aa, Artificial Sequence
  Growth Factor Hybrid Sequence
AHYNTEILKFMDVYQRSYCHPIETLVDIFQEFGVATNTFFKPSCVPLMRCGGCCNSEGLQCVPTEESNITMQIMRIKPHQGQHIGEMSFLQHNKCECRPKKD

SEQ ID NO: 260 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 261 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCVPTEESNITMQIMRIKPHQGQHIGEMSFLQHNKCECRPKKD

SEQ ID NO: 262 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 263 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNSEGLQCVPTEESNITMQIMRIKPHQGQHIGEMSFLQHNKCECRPKKD

SEQ ID NO: 264 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 265 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNSEGLQCVPTEESNITMQIMRIKPHQGQHIGEMSFLQHNKCECRPKKD

SEQ ID NO: 266 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 267 - protein, 102 aa, Artificial Sequence
  Growth Factor Hybrid Sequence
AHYNTEILKFMDVYQRSYCHPREVCIDVGKEFGVATNTFFKPSCVPLMRCGGCCNSEGLQCVPTEESNITMQIMRIKPHQGQHIGEMSFLQHNKCECRPKKD

SEQ ID NO: 268 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 269 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCVPTEESNITMQIMRIKPHQGQHIGEMSFLQHNKCECRPKKD

SEQ ID NO: 270 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 271 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNSEGLQCVPTEESNITMQIMRIKPHQGQHIGEMSFLQHNKCECRPKKD

SEQ ID NO: 272 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 273 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCVPTEESNITMQIMRIKPHQGQHIGEMSFLQHNKCECRPKKD

SEQ ID NO: 274 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 275 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNSEGLQCVPTEESNITMQIMRIKPHQGQHIGEMSFLQHNKCECRPKKD

SEQ ID NO: 276 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 277 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCVPTEESNITMQIMRIKPHQGQHIGEMSFLQHNKCECRPKKD

SEQ ID NO: 278 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 279 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCVPTEESNITMQIMRIKPHQGQHIGEMSFLQHNKCECRPKKD

SEQ ID NO: 280 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 281 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCVPTEESNITMQIMRIKPHQGQHIGEMSFLQHNKCECRPKKD

SEQ ID NO: 282 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 283 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNSEGLQCVPTEESNITMQIMRIKPHQGQHIGEMSFLQHNKCECRPKKD

SEQ ID NO: 284 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 285 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCVPTEESNITMQIMRIKPHQGQHIGEMSFLQHNKCECRPKKD

SEQ ID NO: 286 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 287 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCVPTEESNITMQIMRIKPHQGQHIGEMSFLQHNKCECRPKKD

SEQ ID NO: 288 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 289 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRIKPHQGQHIGEMSFLQHNKCECRPKKD

SEQ ID NO: 290 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 291 - protein, 102 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRIKPHQGQHIGEMSFLQHNKCECRPKKD

SEQ ID NO: 292 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 293 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCVPTEESNITMQIMRIKPHQGQHIGEMSFLQHNKCECRPKKD

SEQ ID NO: 294 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 295 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNSEGLQCVPTEESNITMQIMRIKPHQGQHIGEMSFLQHNKCECRPKKD

SEQ ID NO: 296 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 297 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNSEGLQCVPTEESNITMQIMRIKPHQGQHIGEMSFLQHNKCECRPKKD

SEQ ID NO: 298 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 299 - protein, 102 aa, Artificial Sequence
  Growth Factor Hybrid Sequence
AHYNTEILKFMDVYQRSYCHPREVCIDVGKEFGVATNTFFKPPCVSVYRCGGCCNSEGLQCVPTEESNITMQIMRIKPHQGQHIGEMSFLQHNKCECRPKKD

SEQ ID NO: 300 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 301 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCVPTEESNITMQIMRIKPHQGQHIGEMSFLQHNKCECRPKKD

SEQ ID NO: 302 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttctccagcataacaaatgtgaatgtagaccaaagaaagat

SEQ ID NO: 303 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNSEGLQCVPTEESNITMQIMRIKPHQGQHIGEMSFLQHNKCECRPKKD

SEQ ID NO: 304 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 305 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNDEGLECMNTSTSYLSKTLFEIKPHQGQHIGEMSFLQHNKCECRPKKD

SEQ ID NO: 306 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 307 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNDEGLECMNTSTSYLSKTLFEIKPHQGQHIGEMSFLQHNKCECRPKKD

SEQ ID NO: 308 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 309 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEIKPHQGQHIGEMSFLQHNKCECRPKKD

SEQ ID NO: 310 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 311 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNDEGLECMNTSTSYLSKTLFEIKPHQGQHIGEMSFLQHNKCECRPKKD

SEQ ID NO: 312 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 313 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNDEGLECMNTSTSYLSKTLFEIKPHQGQHIGEMSFLQHNKCECRPKKD

SEQ ID NO: 314 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 315 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNDEGLECMNTSTSYLSKTLFEIKPHQGQHIGEMSFLQHNKCECRPKKD

SEQ ID NO: 316 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 317 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECMNTSTSYLSKTLFEIKPHQGQHIGEMSFLQHNKCECRPKKD

SEQ ID NO: 318 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 319 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNDEGLECMNTSTSYLSKTLFEIKPHQGQHIGEMSFLQHNKCECRPKKD

SEQ ID NO: 320 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 321 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNDEGLECMNTSTSYLSKTLFEIKPHQGQHIGEMSFLQHNKCECRPKKD

SEQ ID NO: 322 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 323 - protein, 102 aa, Artificial Sequence
  Growth Factor Hybrid Sequence
AHYNTEILKFMDVYQRSYCHPIETLVDIFQEFGVATNTFFKPSCVPLMRCGGCCNDEGLECMNTSTSYLSKTLFEIKPHQGQHIGEMSFLQHNKCECRPKKD

SEQ ID NO: 324 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 325 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNDEGLECMNTSTSYLSKTLFEIKPHQGQHIGEMSFLQHNKCECRPKKD

SEQ ID NO: 326 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 327 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNDEGLECMNTSTSYLSKTLFEIKPHQGQHIGEMSFLQHNKCECRPKKD

SEQ ID NO: 328 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 329 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNDEGLECMNTSTSYLSKTLFEIKPHQGQHIGEMSFLQHNKCECRPKKD

SEQ ID NO: 330 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 331 - protein, 102 aa, Artificial Sequence
  Growth Factor Hybrid Sequence
AHYNTEILKFMDVYQRSYCHPREVCIDVGKEFGVATNTFFKPSCVPLMRCGGCCNDEGLECMNTSTSYLSKTLFEIKPHQGQHIGEMSFLQHNKCECRPKKD

SEQ ID NO: 332 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 333 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNDEGLECMNTSTSYLSKTLFEIKPHQGQHIGEMSFLQHNKCECRPKKD

SEQ ID NO: 334 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 335 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNDEGLECMNTSTSYLSKTLFEIKPHQGQHIGEMSFLQHNKCECRPKKD

SEQ ID NO: 336 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 337 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNDEGLECMNTSTSYLSKTLFEIKPHQGQHIGEMSFLQHNKCECRPKKD

SEQ ID NO: 338 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 339 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNDEGLECMNTSTSYLSKTLFEIKPHQGQHIGEMSFLQHNKCECRPKKD

SEQ ID NO: 340 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 341 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECMNTSTSYLSKTLFEIKPHQGQHIGEMSFLQHNKCECRPKKD

SEQ ID NO: 342 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 343 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNDEGLECMNTSTSYLSKTLFEIKPHQGQHIGEMSFLQHNKCECRPKKD

SEQ ID NO: 344 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 345 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNDEGLECMNTSTSYLSKTLFEIKPHQGQHIGEMSFLQHNKCECRPKKD

SEQ ID NO: 346 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 347 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNDEGLECMNTSTSYLSKTLFEIKPHQGQHIGEMSFLQHNKCECRPKKD

SEQ ID NO: 348 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 349 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECMNTSTSYLSKTLFEIKPHQGQHIGEMSFLQHNKCECRPKKD

SEQ ID NO: 350 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 351 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNDEGLECMNTSTSYLSKTLFEIKPHQGQHIGEMSFLQHNKCECRPKKD

SEQ ID NO: 352 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 353 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEIKPHQGQHIGEMSFLQHNKCECRPKKD

SEQ ID NO: 354 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 355 - protein, 102 aa, Artificial Sequence
  Growth Factor Hybrid Sequence
AHYNTEILKFMDVYQRSYCHPIETLVDIFQEFGVATNTFFKPPCVSVYRCGGCCNDEGLECMNTSTSYLSKTLFEIKPHQGQHIGEMSFLQHNKCECRPKKD

SEQ ID NO: 356 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 357 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNDEGLECMNTSTSYLSKTLFEIKPHQGQHIGEMSFLQHNKCECRPKKD

SEQ ID NO: 358 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 359 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNDEGLECMNTSTSYLSKTLFEIKPHQGQHIGEMSFLQHNKCECRPKKD

SEQ ID NO: 360 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 361 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNDEGLECMNTSTSYLSKTLFEIKPHQGQHIGEMSFLQHNKCECRPKKD

SEQ ID NO: 362 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 363 - protein, 102 aa, Artificial Sequence
  Growth Factor Hybrid Sequence
AHYNTEILKFMDVYQRSYCHPREVCIDVGKEFGVATNTFFKPPCVSVYRCGGCCNDEGLECMNTSTSYLSKTLFEIKPHQGQHIGEMSFLQHNKCECRPKKD

SEQ ID NO: 364 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 365 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNDEGLECMNTSTSYLSKTLFEIKPHQGQHIGEMSFLQHNKCECRPKKD

SEQ ID NO: 366 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 367 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNDEGLECMNTSTSYLSKTLFEIKPHQGQHIGEMSFLQHNKCECRPKKD

SEQ ID NO: 368 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 369 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCMNTSTSYLSKTLFEIKPHQGQHIGEMSFLQHNKCECRPKKD

SEQ ID NO: 370 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 371 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNSEGLQCMNTSTSYLSKTLFEIKPHQGQHIGEMSFLQHNKCECRPKKD

SEQ ID NO: 372 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 373 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEIKPHQGQHIGEMSFLQHNKCECRPKKD

SEQ ID NO: 374 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 375 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCMNTSTSYLSKTLFEIKPHQGQHIGEMSFLQHNKCECRPKKD

SEQ ID NO: 376 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 377 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCMNTSTSYLSKTLFEIKPHQGQHIGEMSFLQHNKCECRPKKD

SEQ ID NO: 378 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 379 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNSEGLQCMNTSTSYLSKTLFEIKPHQGQHIGEMSFLQHNKCECRPKKD

SEQ ID NO: 380 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 381 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCMNTSTSYLSKTLFEIKPHQGQHIGEMSFLQHNKCECRPKKD

SEQ ID NO: 382 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 383 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCMNTSTSYLSKTLFEIKPHQGQHIGEMSFLQHNKCECRPKKD

SEQ ID NO: 384 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 385 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNSEGLQCMNTSTSYLSKTLFEIKPHQGQHIGEMSFLQHNKCECRPKKD

SEQ ID NO: 386 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 387 - protein, 102 aa, Artificial Sequence
  Growth Factor Hybrid Sequence
AHYNTEILKFMDVYQRSYCHPIETLVDIFQEFGVATNTFFKPSCVPLMRCGGCCNSEGLQCMNTSTSYLSKTLFEIKPHQGQHIGEMSFLQHNKCECRPKKD

SEQ ID NO: 388 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 389 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCMNTSTSYLSKTLFEIKPHQGQHIGEMSFLQHNKCECRPKKD

SEQ ID NO: 390 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 391 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNSEGLQCMNTSTSYLSKTLFEIKPHQGQHIGEMSFLQHNKCECRPKKD

SEQ ID NO: 392 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 393 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNSEGLQCMNTSTSYLSKTLFEIKPHQGQHIGEMSFLQHNKCECRPKKD

SEQ ID NO: 394 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 395 - protein, 102 aa, Artificial Sequence
  Growth Factor Hybrid Sequence
AHYNTEILKFMDVYQRSYCHPREVCIDVGKEFGVATNTFFKPSCVPLMRCGGCCNSEGLQCMNTSTSYLSKTLFEIKPHQGQHIGEMSFLQHNKCECRPKKD

SEQ ID NO: 396 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 397 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCMNTSTSYLSKTLFEIKPHQGQHIGEMSFLQHNKCECRPKKD

SEQ ID NO: 398 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 399 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNSEGLQCMNTSTSYLSKTLFEIKPHQGQHIGEMSFLQHNKCECRPKKD

SEQ ID NO: 400 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 401 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCMNTSTSYLSKTLFEIKPHQGQHIGEMSFLQHNKCECRPKKD

SEQ ID NO: 402 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 403 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNSEGLQCMNTSTSYLSKTLFEIKPHQGQHIGEMSFLQHNKCECRPKKD

SEQ ID NO: 404 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 405 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCMNTSTSYLSKTLFEIKPHQGQHIGEMSFLQHNKCECRPKKD

SEQ ID NO: 406 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 407 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCMNTSTSYLSKTLFEIKPHQGQHIGEMSFLQHNKCECRPKKD

SEQ ID NO: 408 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 409 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCMNTSTSYLSKTLFEIKPHQGQHIGEMSFLQHNKCECRPKKD

SEQ ID NO: 410 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 411 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNSEGLQCMNTSTSYLSKTLFEIKPHQGQHIGEMSFLQHNKCECRPKKD

SEQ ID NO: 412 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 413 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCMNTSTSYLSKTLFEIKPHQGQHIGEMSFLQHNKCECRPKKD

SEQ ID NO: 414 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 415 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCMNTSTSYLSKTLFEIKPHQGQHIGEMSFLQHNKCECRPKKD

SEQ ID NO: 416 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 417 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEIKPHQGQHIGEMSFLQHNKCECRPKKD

SEQ ID NO: 418 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 419 - protein, 102 aa, Artificial Sequence
  Growth Factor Hybrid Sequence
AHYNTEILKFMDVYQRSYCHPIETLVDIFQEFGVATNTFFKPPCVSVYRCGGCCNSEGLQCMNTSTSYLSKTLFEIKPHQGQHIGEMSFLQHNKCECRPKKD

SEQ ID NO: 420 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 421 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCMNTSTSYLSKTLFEIKPHQGQHIGEMSFLQHNKCECRPKKD

SEQ ID NO: 422 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 423 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNSEGLQCMNTSTSYLSKTLFEIKPHQGQHIGEMSFLQHNKCECRPKKD

SEQ ID NO: 424 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 425 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNSEGLQCMNTSTSYLSKTLFEIKPHQGQHIGEMSFLQHNKCECRPKKD

SEQ ID NO: 426 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 427 - protein, 102 aa, Artificial Sequence
  Growth Factor Hybrid Sequence
AHYNTEILKFMDVYQRSYCHPREVCIDVGKEFGVATNTFFKPPCVSVYRCGGCCNSEGLQCMNTSTSYLSKTLFEIKPHQGQHIGEMSFLQHNKCECRPKKD

SEQ ID NO: 428 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 429 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCMNTSTSYLSKTLFEIKPHQGQHIGEMSFLQHNKCECRPKKD

SEQ ID NO: 430 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttctccagcataacaaatgtgaatgtagaccaaagaaagat

SEQ ID NO: 431 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNSEGLQCMNTSTSYLSKTLFEIKPHQGQHIGEMSFLQHNKCECRPKKD

SEQ ID NO: 432 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 433 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNDEGLECVPTEESNITMQIMRITVPLSQGPKPVTISFLQHNKCECRPKKD

SEQ ID NO: 434 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 435 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNDEGLECVPTEESNITMQIMRITVPLSQGPKPVTISFLQHNKCECRPKKD

SEQ ID NO: 436 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 437 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRITVPLSQGPKPVTISFLQHNKCECRPKKD

SEQ ID NO: 438 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 439 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNDEGLECVPTEESNITMQIMRITVPLSQGPKPVTISFLQHNKCECRPKKD

SEQ ID NO: 440 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 441 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNDEGLECVPTEESNITMQIMRITVPLSQGPKPVTISFLQHNKCECRPKKD

SEQ ID NO: 442 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 443 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNDEGLECVPTEESNITMQIMRITVPLSQGPKPVTISFLQHNKCECRPKKD

SEQ ID NO: 444 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 445 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECVPTEESNITMQIMRITVPLSQGPKPVTISFLQHNKCECRPKKD

SEQ ID NO: 446 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 447 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNDEGLECVPTEESNITMQIMRITVPLSQGPKPVTISFLQHNKCECRPKKD

SEQ ID NO: 448 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 449 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNDEGLECVPTEESNITMQIMRITVPLSQGPKPVTISFLQHNKCECRPKKD

SEQ ID NO: 450 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 451 - protein, 104 aa, Artificial Sequence
  Growth Factor Hybrid Sequence
AHYNTEILKFMDVYQRSYCHPIETLVDIFQEFGVATNTFFKPSCVPLMRCGGCCNDEGLECVPTEESNITMQIMRITVPLSQGPKPVTISFLQHNKCECRPKKD

SEQ ID NO: 452 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 453 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNDEGLECVPTEESNITMQIMRITVPLSQGPKPVTISFLQHNKCECRPKKD

SEQ ID NO: 454 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 455 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNDEGLECVPTEESNITMQIMRITVPLSQGPKPVTISFLQHNKCECRPKKD

SEQ ID NO: 456 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 457 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNDEGLECVPTEESNITMQIMRITVPLSQGPKPVTISFLQHNKCECRPKKD

SEQ ID NO: 458 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 459 - protein, 104 aa, Artificial Sequence
  Growth Factor Hybrid Sequence
AHYNTEILKFMDVYQRSYCHPREVCIDVGKEFGVATNTFFKPSCVPLMRCGGCCNDEGLECVPTEESNITMQIMRITVPLSQGPKPVTISFLQHNKCECRPKKD

SEQ ID NO: 460 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 461 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNDEGLECVPTEESNITMQIMRITVPLSQGPKPVTISFLQHNKCECRPKKD

SEQ ID NO: 462 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 463 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNDEGLECVPTEESNITMQIMRITVPLSQGPKPVTISFLQHNKCECRPKKD

SEQ ID NO: 464 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 465 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNDEGLECVPTEESNITMQIMRITVPLSQGPKPVTISFLQHNKCECRPKKD

SEQ ID NO: 466 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 467 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNDEGLECVPTEESNITMQIMRITVPLSQGPKPVTISFLQHNKCECRPKKD

SEQ ID NO: 468 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 469 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECVPTEESNITMQIMRITVPLSQGPKPVTISFLQHNKCECRPKKD

SEQ ID NO: 470 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 471 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNDEGLECVPTEESNITMQIMRITVPLSQGPKPVTISFLQHNKCECRPKKD

SEQ ID NO: 472 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 473 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNDEGLECVPTEESNITMQIMRITVPLSQGPKPVTISFLQHNKCECRPKKD

SEQ ID NO: 474 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 475 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNDEGLECVPTEESNITMQIMRITVPLSQGPKPVTISFLQHNKCECRPKKD

SEQ ID NO: 476 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 477 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECVPTEESNITMQIMRITVPLSQGPKPVTISFLQHNKCECRPKKD

SEQ ID NO: 478 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 479 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNDEGLECVPTEESNITMQIMRITVPLSQGPKPVTISFLQHNKCECRPKKD

SEQ ID NO: 480 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 481 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRITVPLSQGPKPVTISFLQHNKCECRPKKD

SEQ ID NO: 482 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 483 - protein, 104 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRITVPLSQGPKPVTISFLQHNKCECRPKKD

SEQ ID NO: 484 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 485 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNDEGLECVPTEESNITMQIMRITVPLSQGPKPVTISFLQHNKCECRPKKD

SEQ ID NO: 486 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 487 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNDEGLECVPTEESNITMQIMRITVPLSQGPKPVTISFLQHNKCECRPKKD

SEQ ID NO: 488 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 489 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNDEGLECVPTEESNITMQIMRITVPLSQGPKPVTISFLQHNKCECRPKKD

SEQ ID NO: 490 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 491 - protein, 104 aa, Artificial Sequence
  Growth Factor Hybrid Sequence
AHYNTEILKFMDVYQRSYCHPREVCIDVGKEFGVATNTFFKPPCVSVYRCGGCCNDEGLECVPTEESNITMQIMRITVPLSQGPKPVTISFLQHNKCECRPKKD

SEQ ID NO: 492 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 493 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNDEGLECVPTEESNITMQIMRITVPLSQGPKPVTISFLQHNKCECRPKKD

SEQ ID NO: 494 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 495 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNDEGLECVPTEESNITMQIMRITVPLSQGPKPVTISFLQHNKCECRPKKD

SEQ ID NO: 496 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 497 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCVPTEESNITMQIMRITVPLSQGPKPVTISFLQHNKCECRPKKD

SEQ ID NO: 498 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 499 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNSEGLQCVPTEESNITMQIMRITVPLSQGPKPVTISFLQHNKCECRPKKD

SEQ ID NO: 500 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 501 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRITVPLSQGPKPVTISFLQHNKCECRPKKD

SEQ ID NO: 502 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 503 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCVPTEESNITMQIMRITVPLSQGPKPVTISFLQHNKCECRPKKD

SEQ ID NO: 504 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 505 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCVPTEESNITMQIMRITVPLSQGPKPVTISFLQHNKCECRPKKD

SEQ ID NO: 506 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 507 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNSEGLQCVPTEESNITMQIMRITVPLSQGPKPVTISFLQHNKCECRPKKD

SEQ ID NO: 508 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 509 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCVPTEESNITMQIMRITVPLSQGPKPVTISFLQHNKCECRPKKD

SEQ ID NO: 510 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 511 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCVPTEESNITMQIMRITVPLSQGPKPVTISFLQHNKCECRPKKD

SEQ ID NO: 512 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 513 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNSEGLQCVPTEESNITMQIMRITVPLSQGPKPVTISFLQHNKCECRPKKD

SEQ ID NO: 514 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 515 - protein, 104 aa, Artificial Sequence
  Growth Factor Hybrid Sequence
AHYNTEILKFMDVYQRSYCHPIETLVDIFQEFGVATNTFFKPSCVPLMRCGGCCNSEGLQCVPTEESNITMQIMRITVPLSQGPKPVTISFLQHNKCECRPKKD

SEQ ID NO: 516 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 517 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCVPTEESNITMQIMRITVPLSQGPKPVTISFLQHNKCECRPKKD

SEQ ID NO: 518 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 519 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNSEGLQCVPTEESNITMQIMRITVPLSQGPKPVTISFLQHNKCECRPKKD

SEQ ID NO: 520 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 521 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNSEGLQCVPTEESNITMQIMRITVPLSQGPKPVTISFLQHNKCECRPKKD

SEQ ID NO: 522 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 523 - protein, 104 aa, Artificial Sequence
  Growth Factor Hybrid Sequence
AHYNTEILKFMDVYQRSYCHPREVCIDVGKEFGVATNTFFKPSCVPLMRCGGCCNSEGLQCVPTEESNITMQIMRITVPLSQGPKPVTISFLQHNKCECRPKKD

SEQ ID NO: 524 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 525 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCVPTEESNITMQIMRITVPLSQGPKPVTISFLQHNKCECRPKKD

SEQ ID NO: 526 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 527 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNSEGLQCVPTEESNITMQIMRITVPLSQGPKPVTISFLQHNKCECRPKKD

SEQ ID NO: 528 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 529 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCVPTEESNITMQIMRITVPLSQGPKPVTISFLQHNKCECRPKKD

SEQ ID NO: 530 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 531 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNSEGLQCVPTEESNITMQIMRITVPLSQGPKPVTISFLQHNKCECRPKKD

SEQ ID NO: 532 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 533 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCVPTEESNITMQIMRITVPLSQGPKPVTISFLQHNKCECRPKKD

SEQ ID NO: 534 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 535 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCVPTEESNITMQIMRITVPLSQGPKPVTISFLQHNKCECRPKKD

SEQ ID NO: 536 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 537 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCVPTEESNITMQIMRITVPLSQGPKPVTISFLQHNKCECRPKKD

SEQ ID NO: 538 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 539 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNSEGLQCVPTEESNITMQIMRITVPLSQGPKPVTISFLQHNKCECRPKKD

SEQ ID NO: 540 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 541 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCVPTEESNITMQIMRITVPLSQGPKPVTISFLQHNKCECRPKKD

SEQ ID NO: 542 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 543 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCVPTEESNITMQIMRITVPLSQGPKPVTISFLQHNKCECRPKKD

SEQ ID NO: 544 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 545 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRITVPLSQGPKPVTISFLQHNKCECRPKKD

SEQ ID NO: 546 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 547 - protein, 104 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRITVPLSQGPKPVTISFLQHNKCECRPKKD

SEQ ID NO: 548 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 549 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCVPTEESNITMQIMRITVPLSQGPKPVTISFLQHNKCECRPKKD

SEQ ID NO: 550 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 551 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNSEGLQCVPTEESNITMQIMRITVPLSQGPKPVTISFLQHNKCECRPKKD

SEQ ID NO: 552 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 553 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNSEGLQCVPTEESNITMQIMRITVPLSQGPKPVTISFLQHNKCECRPKKD

SEQ ID NO: 554 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 555 - protein, 104 aa, Artificial Sequence
  Growth Factor Hybrid Sequence
AHYNTEILKFMDVYQRSYCHPREVCIDVGKEFGVATNTFFKPPCVSVYRCGGCCNSEGLQCVPTEESNITMQIMRITVPLSQGPKPVTISFLQHNKCECRPKKD

SEQ ID NO: 556 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 557 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCVPTEESNITMQIMRITVPLSQGPKPVTISFLQHNKCECRPKKD

SEQ ID NO: 558 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttctccagcataacaaatgtgaatgtagaccaaagaaagat

SEQ ID NO: 559 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNSEGLQCVPTEESNITMQIMRITVPLSQGPKPVTISFLQHNKCECRPKKD

SEQ ID NO: 560 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 561 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNDEGLECMNTSTSYLSKTLFEITVPLSQGPKPVTISFLQHNKCECRPKKD

SEQ ID NO: 562 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 563 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNDEGLECMNTSTSYLSKTLFEITVPLSQGPKPVTISFLQHNKCECRPKKD

SEQ ID NO: 564 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 565 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEITVPLSQGPKPVTISFLQHNKCECRPKKD

SEQ ID NO: 566 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 567 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNDEGLECMNTSTSYLSKTLFEITVPLSQGPKPVTISFLQHNKCECRPKKD

SEQ ID NO: 568 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 569 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNDEGLECMNTSTSYLSKTLFEITVPLSQGPKPVTISFLQHNKCECRPKKD

SEQ ID NO: 570 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 571 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNDEGLECMNTSTSYLSKTLFEITVPLSQGPKPVTISFLQHNKCECRPKKD

SEQ ID NO: 572 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 573 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECMNTSTSYLSKTLFEITVPLSQGPKPVTISFLQHNKCECRPKKD

SEQ ID NO: 574 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 575 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNDEGLECMNTSTSYLSKTLFEITVPLSQGPKPVTISFLQHNKCECRPKKD

SEQ ID NO: 576 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 577 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNDEGLECMNTSTSYLSKTLFEITVPLSQGPKPVTISFLQHNKCECRPKKD

SEQ ID NO: 578 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 579 - protein, 104 aa, Artificial Sequence
  Growth Factor Hybrid Sequence
AHYNTEILKFMDVYQRSYCHPIETLVDIFQEFGVATNTFFKPSCVPLMRCGGCCNDEGLECMNTSTSYLSKTLFEITVPLSQGPKPVTISFLQHNKCECRPKKD

SEQ ID NO: 580 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 581 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNDEGLECMNTSTSYLSKTLFEITVPLSQGPKPVTISFLQHNKCECRPKKD

SEQ ID NO: 582 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 583 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNDEGLECMNTSTSYLSKTLFEITVPLSQGPKPVTISFLQHNKCECRPKKD

SEQ ID NO: 584 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 585 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNDEGLECMNTSTSYLSKTLFEITVPLSQGPKPVTISFLQHNKCECRPKKD

SEQ ID NO: 586 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 587 - protein, 104 aa, Artificial Sequence
  Growth Factor Hybrid Sequence
AHYNTEILKFMDVYQRSYCHPREVCIDVGKEFGVATNTFFKPSCVPLMRCGGCCNDEGLECMNTSTSYLSKTLFEITVPLSQGPKPVTISFLQHNKCECRPKKD

SEQ ID NO: 588 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 589 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNDEGLECMNTSTSYLSKTLFEITVPLSQGPKPVTISFLQHNKCECRPKKD

SEQ ID NO: 590 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 591 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNDEGLECMNTSTSYLSKTLFEITVPLSQGPKPVTISFLQHNKCECRPKKD

SEQ ID NO: 592 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 593 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNDEGLECMNTSTSYLSKTLFEITVPLSQGPKPVTISFLQHNKCECRPKKD

SEQ ID NO: 594 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 595 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNDEGLECMNTSTSYLSKTLFEITVPLSQGPKPVTISFLQHNKCECRPKKD

SEQ ID NO: 596 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 597 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECMNTSTSYLSKTLFEITVPLSQGPKPVTISFLQHNKCECRPKKD

SEQ ID NO: 598 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 599 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNDEGLECMNTSTSYLSKTLFEITVPLSQGPKPVTISFLQHNKCECRPKKD

SEQ ID NO: 600 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 601 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNDEGLECMNTSTSYLSKTLFEITVPLSQGPKPVTISFLQHNKCECRPKKD

SEQ ID NO: 602 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 603 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNDEGLECMNTSTSYLSKTLFEITVPLSQGPKPVTISFLQHNKCECRPKKD

SEQ ID NO: 604 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 605 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECMNTSTSYLSKTLFEITVPLSQGPKPVTISFLQHNKCECRPKKD

SEQ ID NO: 606 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 607 - protein, 105 aa, Artificial Sequence; identical to SEQ ID NO: 155
  Growth Factor Hybrid Sequence

SEQ ID NO: 608 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 609 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEITVPLSQGPKPVTISFLQHNKCECRPKKD

SEQ ID NO: 610 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 611 - protein, 104 aa, Artificial Sequence
  Growth Factor Hybrid Sequence
AHYNTEILKFMDVYQRSYCHPIETLVDIFQEFGVATNTFFKPPCVSVYRCGGCCNDEGLECMNTSTSYLSKTLFEITVPLSQGPKPVTISFLQHNKCECRPKKD

SEQ ID NO: 612 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 613 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNDEGLECMNTSTSYLSKTLFEITVPLSQGPKPVTISFLQHNKCECRPKKD

SEQ ID NO: 614 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 615 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNDEGLECMNTSTSYLSKTLFEITVPLSQGPKPVTISFLQHNKCECRPKKD

SEQ ID NO: 616 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 617 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNDEGLECMNTSTSYLSKTLFEITVPLSQGPKPVTISFLQHNKCECRPKKD

SEQ ID NO: 618 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 619 - protein, 104 aa, Artificial Sequence
  Growth Factor Hybrid Sequence
AHYNTEILKFMDVYQRSYCHPREVCIDVGKEFGVATNTFFKPPCVSVYRCGGCCNDEGLECMNTSTSYLSKTLFEITVPLSQGPKPVTISFLQHNKCECRPKKD

SEQ ID NO: 620 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 621 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNDEGLECMNTSTSYLSKTLFEITVPLSQGPKPVTISFLQHNKCECRPKKD

SEQ ID NO: 622 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 623 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNDEGLECMNTSTSYLSKTLFEITVPLSQGPKPVTISFLQHNKCECRPKKD

SEQ ID NO: 624 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 625 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCMNTSTSYLSKTLFEITVPLSQGPKPVTISFLQHNKCECRPKKD

SEQ ID NO: 626 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 627 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNSEGLQCMNTSTSYLSKTLFEITVPLSQGPKPVTISFLQHNKCECRPKKD

SEQ ID NO: 628 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 629 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEITVPLSQGPKPVTISFLQHNKCECRPKKD

SEQ ID NO: 630 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 631 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCMNTSTSYLSKTLFEITVPLSQGPKPVTISFLQHNKCECRPKKD

SEQ ID NO: 632 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 633 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCMNTSTSYLSKTLFEITVPLSQGPKPVTISFLQHNKCECRPKKD

SEQ ID NO: 634 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 635 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNSEGLQCMNTSTSYLSKTLFEITVPLSQGPKPVTISFLQHNKCECRPKKD

SEQ ID NO: 636 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 637 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCMNTSTSYLSKTLFEITVPLSQGPKPVTISFLQHNKCECRPKKD

SEQ ID NO: 638 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 639 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCMNTSTSYLSKTLFEITVPLSQGPKPVTISFLQHNKCECRPKKD

SEQ ID NO: 640 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 641 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNSEGLQCMNTSTSYLSKTLFEITVPLSQGPKPVTISFLQHNKCECRPKKD

SEQ ID NO: 642 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 643 - protein, 104 aa, Artificial Sequence
  Growth Factor Hybrid Sequence
AHYNTEILKFMDVYQRSYCHPIETLVDIFQEFGVATNTFFKPSCVPLMRCGGCCNSEGLQCMNTSTSYLSKTLFEITVPLSQGPKPVTISFLQHNKCECRPKKD

SEQ ID NO: 644 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 645 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCMNTSTSYLSKTLFEITVPLSQGPKPVTISFLQHNKCECRPKKD

SEQ ID NO: 646 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 647 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNSEGLQCMNTSTSYLSKTLFEITVPLSQGPKPVTISFLQHNKCECRPKKD

SEQ ID NO: 648 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 649 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNSEGLQCMNTSTSYLSKTLFEITVPLSQGPKPVTISFLQHNKCECRPKKD

SEQ ID NO: 650 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 651 - protein, 104 aa, Artificial Sequence
  Growth Factor Hybrid Sequence
AHYNTEILKFMDVYQRSYCHPREVCIDVGKEFGVATNTFFKPSCVPLMRCGGCCNSEGLQCMNTSTSYLSKTLFEITVPLSQGPKPVTISFLQHNKCECRPKKD

SEQ ID NO: 652 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 653 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCMNTSTSYLSKTLFEITVPLSQGPKPVTISFLQHNKCECRPKKD

SEQ ID NO: 654 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 655 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNSEGLQCMNTSTSYLSKTLFEITVPLSQGPKPVTISFLQHNKCECRPKKD

SEQ ID NO: 656 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 657 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCMNTSTSYLSKTLFEITVPLSQGPKPVTISFLQHNKCECRPKKD

SEQ ID NO: 658 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 659 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNSEGLQCMNTSTSYLSKTLFEITVPLSQGPKPVTISFLQHNKCECRPKKD

SEQ ID NO: 660 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 661 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCMNTSTSYLSKTLFEITVPLSQGPKPVTISFLQHNKCECRPKKD

SEQ ID NO: 662 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 663 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCMNTSTSYLSKTLFEITVPLSQGPKPVTISFLQHNKCECRPKKD

SEQ ID NO: 664 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 665 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCMNTSTSYLSKTLFEITVPLSQGPKPVTISFLQHNKCECRPKKD

SEQ ID NO: 666 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 667 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNSEGLQCMNTSTSYLSKTLFEITVPLSQGPKPVTISFLQHNKCECRPKKD

SEQ ID NO: 668 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 669 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCMNTSTSYLSKTLFEITVPLSQGPKPVTISFLQHNKCECRPKKD

SEQ ID NO: 670 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 671 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCMNTSTSYLSKTLFEITVPLSQGPKPVTISFLQHNKCECRPKKD

SEQ ID NO: 672 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 673 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEITVPLSQGPKPVTISFLQHNKCECRPKKD

SEQ ID NO: 674 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 675 - protein, 104 aa, Artificial Sequence
  Growth Factor Hybrid Sequence
AHYNTEILKFMDVYQRSYCHPIETLVDIFQEFGVATNTFFKPPCVSVYRCGGCCNSEGLQCMNTSTSYLSKTLFEITVPLSQGPKPVTISFLQHNKCECRPKKD

SEQ ID NO: 676 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 677 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCMNTSTSYLSKTLFEITVPLSQGPKPVTISFLQHNKCECRPKKD

SEQ ID NO: 678 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 679 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNSEGLQCMNTSTSYLSKTLFEITVPLSQGPKPVTISFLQHNKCECRPKKD

SEQ ID NO: 680 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 681 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNSEGLQCMNTSTSYLSKTLFEITVPLSQGPKPVTISFLQHNKCECRPKKD

SEQ ID NO: 682 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 683 - protein, 104 aa, Artificial Sequence
  Growth Factor Hybrid Sequence
AHYNTEILKFMDVYQRSYCHPREVCIDVGKEFGVATNTFFKPPCVSVYRCGGCCNSEGLQCMNTSTSYLSKTLFEITVPLSQGPKPVTISFLQHNKCECRPKKD

SEQ ID NO: 684 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 685 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCMNTSTSYLSKTLFEITVPLSQGPKPVTISFLQHNKCECRPKKD

SEQ ID NO: 686 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttctccagcataacaaatgtgaatgtagaccaaagaaagat

SEQ ID NO: 687 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNSEGLQCMNTSTSYLSKTLFEITVPLSQGPKPVTISFLQHNKCECRPKKD

SEQ ID NO: 688 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 689 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNDEGLECVPTEESNITMQIMRIKPHQGQHIGEMSFANHTSCRCMSKLD

SEQ ID NO: 690 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 691 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNDEGLECVPTEESNITMQIMRIKPHQGQHIGEMSFANHTSCRCMSKLD

SEQ ID NO: 692 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 693 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRIKPHQGQHIGEMSFANHTSCRCMSKLD

SEQ ID NO: 694 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 695 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNDEGLECVPTEESNITMQIMRIKPHQGQHIGEMSFANHTSCRCMSKLD

SEQ ID NO: 696 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 697 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNDEGLECVPTEESNITMQIMRIKPHQGQHIGEMSFANHTSCRCMSKLD

SEQ ID NO: 698 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 699 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNDEGLECVPTEESNITMQIMRIKPHQGQHIGEMSFANHTSCRCMSKLD

SEQ ID NO: 700 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 701 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECVPTEESNITMQIMRIKPHQGQHIGEMSFANHTSCRCMSKLD

SEQ ID NO: 702 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 703 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNDEGLECVPTEESNITMQIMRIKPHQGQHIGEMSFANHTSCRCMSKLD

SEQ ID NO: 704 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 705 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNDEGLECVPTEESNITMQIMRIKPHQGQHIGEMSFANHTSCRCMSKLD

SEQ ID NO: 706 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 707 - protein, 102 aa, Artificial Sequence
  Growth Factor Hybrid Sequence
AHYNTEILKFMDVYQRSYCHPIETLVDIFQEFGVATNTFFKPSCVPLMRCGGCCNDEGLECVPTEESNITMQIMRIKPHQGQHIGEMSFANHTSCRCMSKLD

SEQ ID NO: 708 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 709 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNDEGLECVPTEESNITMQIMRIKPHQGQHIGEMSFANHTSCRCMSKLD

SEQ ID NO: 710 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 711 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNDEGLECVPTEESNITMQIMRIKPHQGQHIGEMSFANHTSCRCMSKLD

SEQ ID NO: 712 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 713 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNDEGLECVPTEESNITMQIMRIKPHQGQHIGEMSFANHTSCRCMSKLD

SEQ ID NO: 714 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 715 - protein, 102 aa, Artificial Sequence
  Growth Factor Hybrid Sequence
AHYNTEILKFMDVYQRSYCHPREVCIDVGKEFGVATNTFFKPSCVPLMRCGGCCNDEGLECVPTEESNITMQIMRIKPHQGQHIGEMSFANHTSCRCMSKLD

SEQ ID NO: 716 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 717 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNDEGLECVPTEESNITMQIMRIKPHQGQHIGEMSFANHTSCRCMSKLD

SEQ ID NO: 718 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 719 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNDEGLECVPTEESNITMQIMRIKPHQGQHIGEMSFANHTSCRCMSKLD

SEQ ID NO: 720 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 721 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNDEGLECVPTEESNITMQIMRIKPHQGQHIGEMSFANHTSCRCMSKLD

SEQ ID NO: 722 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 723 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNDEGLECVPTEESNITMQIMRIKPHQGQHIGEMSFANHTSCRCMSKLD

SEQ ID NO: 724 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 725 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECVPTEESNITMQIMRIKPHQGQHIGEMSFANHTSCRCMSKLD

SEQ ID NO: 726 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 727 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNDEGLECVPTEESNITMQIMRIKPHQGQHIGEMSFANHTSCRCMSKLD

SEQ ID NO: 728 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 729 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNDEGLECVPTEESNITMQIMRIKPHQGQHIGEMSFANHTSCRCMSKLD

SEQ ID NO: 730 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 731 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNDEGLECVPTEESNITMQIMRIKPHQGQHIGEMSFANHTSCRCMSKLD

SEQ ID NO: 732 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 733 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECVPTEESNITMQIMRIKPHQGQHIGEMSFANHTSCRCMSKLD

SEQ ID NO: 734 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 735 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNDEGLECVPTEESNITMQIMRIKPHQGQHIGEMSFANHTSCRCMSKLD

SEQ ID NO: 736 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 737 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRIKPHQGQHIGEMSFANHTSCRCMSKLD

SEQ ID NO: 738 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 739 - protein, 102 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRIKPHQGQHIGEMSFANHTSCRCMSKLD

SEQ ID NO: 740 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 741 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNDEGLECVPTEESNITMQIMRIKPHQGQHIGEMSFANHTSCRCMSKLD

SEQ ID NO: 742 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 743 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNDEGLECVPTEESNITMQIMRIKPHQGQHIGEMSFANHTSCRCMSKLD

SEQ ID NO: 744 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 745 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNDEGLECVPTEESNITMQIMRIKPHQGQHIGEMSFANHTSCRCMSKLD

SEQ ID NO: 746 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 747 - protein, 102 aa, Artificial Sequence
  Growth Factor Hybrid Sequence
AHYNTEILKFMDVYQRSYCHPREVCIDVGKEFGVATNTFFKPPCVSVYRCGGCCNDEGLECVPTEESNITMQIMRIKPHQGQHIGEMSFANHTSCRCMSKLD

SEQ ID NO: 748 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 749 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNDEGLECVPTEESNITMQIMRIKPHQGQHIGEMSFANHTSCRCMSKLD

SEQ ID NO: 750 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 751 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNDEGLECVPTEESNITMQIMRIKPHQGQHIGEMSFANHTSCRCMSKLD

SEQ ID NO: 752 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 753 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCVPTEESNITMQIMRIKPHQGQHIGEMSFANHTSCRCMSKLD

SEQ ID NO: 754 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 755 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNSEGLQCVPTEESNITMQIMRIKPHQGQHIGEMSFANHTSCRCMSKLD

SEQ ID NO: 756 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 757 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRIKPHQGQHIGEMSFANHTSCRCMSKLD

SEQ ID NO: 758 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 759 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCVPTEESNITMQIMRIKPHQGQHIGEMSFANHTSCRCMSKLD

SEQ ID NO: 760 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 761 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCVPTEESNITMQIMRIKPHQGQHIGEMSFANHTSCRCMSKLD

SEQ ID NO: 762 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 763 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNSEGLQCVPTEESNITMQIMRIKPHQGQHIGEMSFANHTSCRCMSKLD

SEQ ID NO: 764 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 765 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCVPTEESNITMQIMRIKPHQGQHIGEMSFANHTSCRCMSKLD

SEQ ID NO: 766 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 767 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCVPTEESNITMQIMRIKPHQGQHIGEMSFANHTSCRCMSKLD

SEQ ID NO: 768 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 769 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNSEGLQCVPTEESNITMQIMRIKPHQGQHIGEMSFANHTSCRCMSKLD

SEQ ID NO: 770 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 771 - protein, 102 aa, Artificial Sequence
  Growth Factor Hybrid Sequence
AHYNTEILKFMDVYQRSYCHPIETLVDIFQEFGVATNTFFKPSCVPLMRCGGCCNSEGLQCVPTEESNITMQIMRIKPHQGQHIGEMSFANHTSCRCMSKLD

SEQ ID NO: 772 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 773 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCVPTEESNITMQIMRIKPHQGQHIGEMSFANHTSCRCMSKLD

SEQ ID NO: 774 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 775 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNSEGLQCVPTEESNITMQIMRIKPHQGQHIGEMSFANHTSCRCMSKLD

SEQ ID NO: 776 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 777 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNSEGLQCVPTEESNITMQIMRIKPHQGQHIGEMSFANHTSCRCMSKLD

SEQ ID NO: 778 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 779 - protein, 102 aa, Artificial Sequence
  Growth Factor Hybrid Sequence
AHYNTEILKFMDVYQRSYCHPREVCIDVGKEFGVATNTFFKPSCVPLMRCGGCCNSEGLQCVPTEESNITMQIMRIKPHQGQHIGEMSFANHTSCRCMSKLD

SEQ ID NO: 780 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 781 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCVPTEESNITMQIMRIKPHQGQHIGEMSFANHTSCRCMSKLD

SEQ ID NO: 782 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 783 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNSEGLQCVPTEESNITMQIMRIKPHQGQHIGEMSFANHTSCRCMSKLD

SEQ ID NO: 784 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 785 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCVPTEESNITMQIMRIKPHQGQHIGEMSFANHTSCRCMSKLD

SEQ ID NO: 786 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 787 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNSEGLQCVPTEESNITMQIMRIKPHQGQHIGEMSFANHTSCRCMSKLD

SEQ ID NO: 788 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 789 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCVPTEESNITMQIMRIKPHQGQHIGEMSFANHTSCRCMSKLD

SEQ ID NO: 790 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 791 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCVPTEESNITMQIMRIKPHQGQHIGEMSFANHTSCRCMSKLD

SEQ ID NO: 792 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 793 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCVPTEESNITMQIMRIKPHQGQHIGEMSFANHTSCRCMSKLD

SEQ ID NO: 794 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 795 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNSEGLQCVPTEESNITMQIMRIKPHQGQHIGEMSFANHTSCRCMSKLD

SEQ ID NO: 796 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 797 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCVPTEESNITMQIMRIKPHQGQHIGEMSFANHTSCRCMSKLD

SEQ ID NO: 798 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 799 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCVPTEESNITMQIMRIKPHQGQHIGEMSFANHTSCRCMSKLD

SEQ ID NO: 800 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 801 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRIKPHQGQHIGEMSFANHTSCRCMSKLD

SEQ ID NO: 802 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 803 - protein, 102 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRIKPHQGQHIGEMSFANHTSCRCMSKLD

SEQ ID NO: 804 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 805 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCVPTEESNITMQIMRIKPHQGQHIGEMSFANHTSCRCMSKLD

SEQ ID NO: 806 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 807 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNSEGLQCVPTEESNITMQIMRIKPHQGQHIGEMSFANHTSCRCMSKLD

SEQ ID NO: 808 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 809 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNSEGLQCVPTEESNITMQIMRIKPHQGQHIGEMSFANHTSCRCMSKLD

SEQ ID NO: 810 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 811 - protein, 102 aa, Artificial Sequence
  Growth Factor Hybrid Sequence
AHYNTEILKFMDVYQRSYCHPREVCIDVGKEFGVATNTFFKPPCVSVYRCGGCCNSEGLQCVPTEESNITMQIMRIKPHQGQHIGEMSFANHTSCRCMSKLD

SEQ ID NO: 812 - DNA, 309 bp, Artificial Sequence
  Growth Factor Hybrid Sequence
  CDS (1)..(306)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 813 - protein, 102 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCVPTEESNITMQIMRIKPHQGQHIGEMSFANHTSCRCMSKL

SEQ ID NO: 814 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattaaacctcaccaagggcagcacatcggagagatgagctttgccaatcacacttcctgccgatgcatgtctaagctggat

SEQ ID NO: 815 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNSEGLQCVPTEESNITMQIMRIKPHQGQHIGEMSFANHTSCRCMSKLD

SEQ ID NO: 816 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 817 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNDEGLECMNTSTSYLSKTLFEIKPHQGQHIGEMSFANHTSCRCMSKLD

SEQ ID NO: 818 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 819 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNDEGLECMNTSTSYLSKTLFEIKPHQGQHIGEMSFANHTSCRCMSKLD

SEQ ID NO: 820 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 821 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEIKPHQGQHIGEMSFANHTSCRCMSKLD

SEQ ID NO: 822 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 823 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNDEGLECMNTSTSYLSKTLFEIKPHQGQHIGEMSFANHTSCRCMSKLD

SEQ ID NO: 824 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 825 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNDEGLECMNTSTSYLSKTLFEIKPHQGQHIGEMSFANHTSCRCMSKLD

SEQ ID NO: 826 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 827 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNDEGLECMNTSTSYLSKTLFEIKPHQGQHIGEMSFANHTSCRCMSKLD

SEQ ID NO: 828 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 829 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECMNTSTSYLSKTLFEIKPHQGQHIGEMSFANHTSCRCMSKLD

SEQ ID NO: 830 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 831 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNDEGLECMNTSTSYLSKTLFEIKPHQGQHIGEMSFANHTSCRCMSKLD

SEQ ID NO: 832 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 833 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNDEGLECMNTSTSYLSKTLFEIKPHQGQHIGEMSFANHTSCRCMSKLD

SEQ ID NO: 834 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 835 - protein, 102 aa, Artificial Sequence
  Growth Factor Hybrid Sequence
AHYNTEILKFMDVYQRSYCHPIETLVDIFQEFGVATNTFFKPSCVPLMRCGGCCNDEGLECMNTSTSYLSKTLFEIKPHQGQHIGEMSFANHTSCRCMSKLD

SEQ ID NO: 836 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 837 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNDEGLECMNTSTSYLSKTLFEIKPHQGQHIGEMSFANHTSCRCMSKLD

SEQ ID NO: 838 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 839 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNDEGLECMNTSTSYLSKTLFEIKPHQGQHIGEMSFANHTSCRCMSKLD

SEQ ID NO: 840 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 841 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNDEGLECMNTSTSYLSKTLFEIKPHQGQHIGEMSFANHTSCRCMSKLD

SEQ ID NO: 842 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 843 - protein, 102 aa, Artificial Sequence
  Growth Factor Hybrid Sequence
AHYNTEILKFMDVYQRSYCHPREVCIDVGKEFGVATNTFFKPSCVPLMRCGGCCNDEGLECMNTSTSYLSKTLFEIKPHQGQHIGEMSFANHTSCRCMSKLD

SEQ ID NO: 844 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 845 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNDEGLECMNTSTSYLSKTLFEIKPHQGQHIGEMSFANHTSCRCMSKLD

SEQ ID NO: 846 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 847 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNDEGLECMNTSTSYLSKTLFEIKPHQGQHIGEMSFANHTSCRCMSKLD

SEQ ID NO: 848 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 849 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNDEGLECMNTSTSYLSKTLFEIKPHQGQHIGEMSFANHTSCRCMSKLD

SEQ ID NO: 850 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 851 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNDEGLECMNTSTSYLSKTLFEIKPHQGQHIGEMSFANHTSCRCMSKLD

SEQ ID NO: 852 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 853 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECMNTSTSYLSKTLFEIKPHQGQHIGEMSFANHTSCRCMSKLD

SEQ ID NO: 854 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 855 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNDEGLECMNTSTSYLSKTLFEIKPHQGQHIGEMSFANHTSCRCMSKLD

SEQ ID NO: 856 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 857 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNDEGLECMNTSTSYLSKTLFEIKPHQGQHIGEMSFANHTSCRCMSKLD

SEQ ID NO: 858 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 859 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNDEGLECMNTSTSYLSKTLFEIKPHQGQHIGEMSFANHTSCRCMSKLD

SEQ ID NO: 860 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 861 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECMNTSTSYLSKTLFEIKPHQGQHIGEMSFANHTSCRCMSKLD

SEQ ID NO: 862 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 863 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNDEGLECMNTSTSYLSKTLFEIKPHQGQHIGEMSFANHTSCRCMSKLD

SEQ ID NO: 864 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 865 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEIKPHQGQHIGEMSFANHTSCRCMSKLD

SEQ ID NO: 866 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 867 - protein, 102 aa, Artificial Sequence
  Growth Factor Hybrid Sequence
AHYNTEILKFMDVYQRSYCHPIETLVDIFQEFGVATNTFFKPPCVSVYRCGGCCNDEGLECMNTSTSYLSKTLFEIKPHQGQHIGEMSFANHTSCRCMSKLD

SEQ ID NO: 868 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 869 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNDEGLECMNTSTSYLSKTLFEIKPHQGQHIGEMSFANHTSCRCMSKLD

SEQ ID NO: 870 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 871 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNDEGLECMNTSTSYLSKTLFEIKPHQGQHIGEMSFANHTSCRCMSKLD

SEQ ID NO: 872 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 873 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNDEGLECMNTSTSYLSKTLFEIKPHQGQHIGEMSFANHTSCRCMSKLD

SEQ ID NO: 874 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 875 - protein, 102 aa, Artificial Sequence
  Growth Factor Hybrid Sequence
AHYNTEILKFMDVYQRSYCHPREVCIDVGKEFGVATNTFFKPPCVSVYRCGGCCNDEGLECMNTSTSYLSKTLFEIKPHQGQHIGEMSFANHTSCRCMSKLD

SEQ ID NO: 876 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 877 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNDEGLECMNTSTSYLSKTLFEIKPHQGQHIGEMSFANHTSCRCMSKLD

SEQ ID NO: 878 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 879 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNDEGLECMNTSTSYLSKTLFEIKPHQGQHIGEMSFANHTSCRCMSKLD

SEQ ID NO: 880 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 881 - protein, 102 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCMNTSTSYLSKTLFEIKPHQGQHIGEMSFANHTSCRCMSKLD

SEQ ID NO: 882 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 883 - protein, 102 aa, Artificial Sequence
  Growth Factor Hybrid Sequence
AHYNTEILKFMDVYQRSYCHPIETLVDIFQEYPDEIEYIFKPSCVPLMRCGGCCNSEGLQCMNTSTSYLSKTLFEIKPHQGQHIGEMSFANHTSCRCMSKLD

SEQ ID NO: 884 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 885 - protein, 103 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEIKPHQGQHIGEMSFANHTSCRCMSKLD

SEQ ID NO: 886 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 887 - protein, 103 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCMNTSTSYLSKTLFEIKPHQGQHIGEMSFANHTSCRCMSKLD

SEQ ID NO: 888 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 889 - protein, 102 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCMNTSTSYLSKTLFEIKPHQGQHIGEMSFANHTSCRCMSKLD

SEQ ID NO: 890 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 891 - protein, 102 aa, Artificial Sequence
  Growth Factor Hybrid Sequence
AHYNTEILKFMDVYQRSYCHPREVCIDVGKEYPDEIEYIFKPSCVPLMRCGGCCNSEGLQCMNTSTSYLSKTLFEIKPHQGQHIGEMSFANHTSCRCMSKLD

SEQ ID NO: 892 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 893 - protein, 103 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCMNTSTSYLSKTLFEIKPHQGQHIGEMSFANHTSCRCMSKLD

SEQ ID NO: 894 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 895 - protein, 103 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCMNTSTSYLSKTLFEIKPHQGQHIGEMSFANHTSCRCMSKLD

SEQ ID NO: 896 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 897 - protein, 102 aa, Artificial Sequence
  Growth Factor Hybrid Sequence
GQNHHEVVKFMDVYQRSYCHPIETLVDIFQEFGVATNTFFKPSCVPLMRCGGCCNSEGLQCMNTSTSYLSKTLFEIKPHQGQHIGEMSFANHTSCRCMSKLD

SEQ ID NO: 898 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 899 - protein, 102 aa, Artificial Sequence
  Growth Factor Hybrid Sequence
AHYNTEILKFMDVYQRSYCHPIETLVDIFQEFGVATNTFFKPSCVPLMRCGGCCNSEGLQCMNTSTSYLSKTLFEIKPHQGQHIGEMSFANHTSCRCMSKLD

SEQ ID NO: 900 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 901 - protein, 103 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCMNTSTSYLSKTLFEIKPHQGQHIGEMSFANHTSCRCMSKLD

SEQ ID NO: 902 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 903 - protein, 103 aa, Artificial Sequence
  Growth Factor Hybrid Sequence
AHYNTEILKSIDNEWRKTQCMPIETLVDIFQEFGVATNTFFKPSCVPLMRCGGCCNSEGLQCMNTSTSYLSKTLFEIKPHQGQHIGEMSFANHTSCRCMSKLD

SEQ ID NO: 904 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 905 - protein, 102 aa, Artificial Sequence
  Growth Factor Hybrid Sequence
GQNHHEVVKFMDVYQRSYCHPREVCIDVGKEFGVATNTFFKPSCVPLMRCGGCCNSEGLQCMNTSTSYLSKTLFEIKPHQGQHIGEMSFANHTSCRCMSKLD

SEQ ID NO: 906 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 907 - protein, 102 aa, Artificial Sequence
  Growth Factor Hybrid Sequence
AHYNTEILKFMDVYQRSYCHPREVCIDVGKEFGVATNTFFKPSCVPLMRCGGCCNSEGLQCMNTSTSYLSKTLFEIKPHQGQHIGEMSFANHTSCRCMSKLD

SEQ ID NO: 908 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 909 - protein, 103 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCMNTSTSYLSKTLFEIKPHQGQHIGEMSFANHTSCRCMSKLD

SEQ ID NO: 910 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 911 - protein, 103 aa, Artificial Sequence
  Growth Factor Hybrid Sequence
AHYNTEILKSIDNEWRKTQCMPREVCIDVGKEFGVATNTFFKPSCVPLMRCGGCCNSEGLQCMNTSTSYLSKTLFEIKPHQGQHIGEMSFANHTSCRCMSKLD

SEQ ID NO: 912 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 913 - protein, 102 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCMNTSTSYLSKTLFEIKPHQGQHIGEMSFANHTSCRCMSKLD

SEQ ID NO: 914 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 915 - protein, 102 aa, Artificial Sequence
  Growth Factor Hybrid Sequence
AHYNTEILKFMDVYQRSYCHPIETLVDIFQEYPDEIEYIFKPPCVSVYRCGGCCNSEGLQCMNTSTSYLSKTLFEIKPHQGQHIGEMSFANHTSCRCMSKLD

SEQ ID NO: 916 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 917 - protein, 103 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCMNTSTSYLSKTLFEIKPHQGQHIGEMSFANHTSCRCMSKLD

SEQ ID NO: 918 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 919 - protein, 103 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCMNTSTSYLSKTLFEIKPHQGQHIGEMSFANHTSCRCMSKLD

SEQ ID NO: 920 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 921 - protein, 102 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCMNTSTSYLSKTLFEIKPHQGQHIGEMSFANHTSCRCMSKLD

SEQ ID NO: 922 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 923 - protein, 102 aa, Artificial Sequence
  Growth Factor Hybrid Sequence
AHYNTEILKFMDVYQRSYCHPREVCIDVGKEYPDEIEYIFKPPCVSVYRCGGCCNSEGLQCMNTSTSYLSKTLFEIKPHQGQHIGEMSFANHTSCRCMSKLD

SEQ ID NO: 924 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 925 - protein, 103 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCMNTSTSYLSKTLFEIKPHQGQHIGEMSFANHTSCRCMSKLD

SEQ ID NO: 926 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 927 - protein, 103 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCMNTSTSYLSKTLFEIKPHQGQHIGEMSFANHTSCRCMSKLD

SEQ ID NO: 928 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 929 - protein, 102 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEIKPHQGQHIGEMSFANHTSCRCMSKLD

SEQ ID NO: 930 - DNA, 306 bp, Artificial Sequence
  Growth Factor Hybrid Sequence
  CDS (1)..(306)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 931 - protein, 102 aa, Artificial Sequence
  Growth Factor Hybrid Sequence
AHYNTEILKFMDVYQRSYCHPIETLVDIFQEFGVATNTFFKPPCVSVYRCGGCCNSEGLQCMNTSTSYLSKTLFEIKPHQGQHIGEMSFANHTSCRCMSKLD

SEQ ID NO: 932 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 933 - protein, 103 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCMNTSTSYLSKTLFEIKPHQGQHIGEMSFANHTSCRCMSKLD

SEQ ID NO: 934 - DNA, 309 bp, Artificial Sequence
  Growth Factor Hybrid Sequence
  CDS (1)..(309)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 935 - protein, 103 aa, Artificial Sequence
  Growth Factor Hybrid Sequence
AHYNTEILKSIDNEWRKTQCMPIETLVDIFQEFGVATNTFFKPPCVSVYRCGGCCNSEGLQCMNTSTSYLSKTLFEIKPHQGQHIGEMSFANHTSCRCMSKLD

SEQ ID NO: 936 - DNA, 306 bp, Artificial Sequence
  Growth Factor Hybrid Sequence
  CDS (1)..(306)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 937 - protein, 102 aa, Artificial Sequence
  Growth Factor Hybrid Sequence
GQNHHEVVKFMDVYQRSYCHPREVCIDVGKEFGVATNTFFKPPCVSVYRCGGCCNSEGLQCMNTSTSYLSKTLFEIKPHQGQHIGEMSFANHTSCRCMSKLD

SEQ ID NO: 938 - DNA, 306 bp, Artificial Sequence
  Growth Factor Hybrid Sequence
  CDS (1)..(306)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 939 - protein, 102 aa, Artificial Sequence
  Growth Factor Hybrid Sequence
AHYNTEILKFMDVYQRSYCHPREVCIDVGKEFGVATNTFFKPPCVSVYRCGGCCNSEGLQCMNTSTSYLSKTLFEIKPHQGQHIGEMSFANHTSCRCMSKLD

SEQ ID NO: 940 - DNA, 309 bp, Artificial Sequence
  Growth Factor Hybrid Sequence
  CDS (1)..(309)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 941 - protein, 103 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCMNTSTSYLSKTLFEIKPHQGQHIGEMSFANHTSCRCMSKLD

SEQ ID NO: 942 - DNA, 309 bp, Artificial Sequence
  Growth Factor Hybrid Sequence
  CDS (1)..(309)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattaaacctcaccaagggcagcacatcggagagatgagctttgccaatcacacttcctgccgatgcatgtctaagctggat

SEQ ID NO: 943 - protein, 103 aa, Artificial Sequence
  Growth Factor Hybrid Sequence
AHYNTEILKSIDNEWRKTQCMPREVCIDVGKEFGVATNTFFKPPCVSVYRCGGCCNSEGLQCMNTSTSYLSKTLFEIKPHQGQHIGEMSFANHTSCRCMSKLD

SEQ ID NO: 944 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 945 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNDEGLECVPTEESNITMQIMRITVPLSQGPKPVTISFANHTSCRCMSKLD

SEQ ID NO: 946 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 947 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNDEGLECVPTEESNITMQIMRITVPLSQGPKPVTISFANHTSCRCMSKLD

SEQ ID NO: 948 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 949 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECVPTEESNITMQIMRITVPLSQGPKPVTISFANHTSCRCMSKLD

SEQ ID NO: 950 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 951 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNDEGLECVPTEESNITMQIMRITVPLSQGPKPVTISFANHTSCRCMSKLD

SEQ ID NO: 952 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 953 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNDEGLECVPTEESNITMQIMRITVPLSQGPKPVTISFANHTSCRCMSKLD

SEQ ID NO: 954 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 955 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNDEGLECVPTEESNITMQIMRITVPLSQGPKPVTISFANHTSCRCMSKLD

SEQ ID NO: 956 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 957 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECVPTEESNITMQIMRITVPLSQGPKPVTISFANHTSCRCMSKLD

SEQ ID NO: 958 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 959 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNDEGLECVPTEESNITMQIMRITVPLSQGPKPVTISFANHTSCRCMSKLD

SEQ ID NO: 960 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 961 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNDEGLECVPTEESNITMQIMRITVPLSQGPKPVTISFANHTSCRCMSKLD

SEQ ID NO: 962 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 963 - protein, 104 aa, Artificial Sequence
  Growth Factor Hybrid Sequence
AHYNTEILKFMDVYQRSYCHPIETLVDIFQEFGVATNTFFKPSCVPLMRCGGCCNDEGLECVPTEESNITMQIMRITVPLSQGPKPVTISFANHTSCRCMSKLD

SEQ ID NO: 964 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 965 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNDEGLECVPTEESNITMQIMRITVPLSQGPKPVTISFANHTSCRCMSKLD

SEQ ID NO: 966 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 967 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNDEGLECVPTEESNITMQIMRITVPLSQGPKPVTISFANHTSCRCMSKLD

SEQ ID NO: 968 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 969 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNDEGLECVPTEESNITMQIMRITVPLSQGPKPVTISFANHTSCRCMSKLD

SEQ ID NO: 970 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 971 - protein, 104 aa, Artificial Sequence
  Growth Factor Hybrid Sequence
AHYNTEILKFMDVYQRSYCHPREVCIDVGKEFGVATNTFFKPSCVPLMRCGGCCNDEGLECVPTEESNITMQIMRITVPLSQGPKPVTISFANHTSCRCMSKLD

SEQ ID NO: 972 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 973 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNDEGLECVPTEESNITMQIMRITVPLSQGPKPVTISFANHTSCRCMSKLD

SEQ ID NO: 974 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 975 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNDEGLECVPTEESNITMQIMRITVPLSQGPKPVTISFANHTSCRCMSKLD

SEQ ID NO: 976 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 977 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNDEGLECVPTEESNITMQIMRITVPLSQGPKPVTISFANHTSCRCMSKLD

SEQ ID NO: 978 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 979 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNDEGLECVPTEESNITMQIMRITVPLSQGPKPVTISFANHTSCRCMSKLD

SEQ ID NO: 980 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 981 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECVPTEESNITMQIMRITVPLSQGPKPVTISFANHTSCRCMSKLD

SEQ ID NO: 982 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 983 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNDEGLECVPTEESNITMQIMRITVPLSQGPKPVTISFANHTSCRCMSKLD

SEQ ID NO: 984 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 985 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNDEGLECVPTEESNITMQIMRITVPLSQGPKPVTISFANHTSCRCMSKLD

SEQ ID NO: 986 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 987 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNDEGLECVPTEESNITMQIMRITVPLSQGPKPVTISFANHTSCRCMSKLD

SEQ ID NO: 988 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 989 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECVPTEESNITMQIMRITVPLSQGPKPVTISFANHTSCRCMSKLD

SEQ ID NO: 990 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 991 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNDEGLECVPTEESNITMQIMRITVPLSQGPKPVTISFANHTSCRCMSKLD

SEQ ID NO: 992 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 993 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNDEGLECVPTEESNITMQIMRITVPLSQGPKPVTISFANHTSCRCMSKLD

SEQ ID NO: 994 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 995 - protein, 104 aa, Artificial Sequence
  Growth Factor Hybrid Sequence
AHYNTEILKFMDVYQRSYCHPIETLVDIFQEFGVATNTFFKPPCVSVYRCGGCCNDEGLECVPTEESNITMQIMRITVPLSQGPKPVTISFANHTSCRCMSKLD

SEQ ID NO: 996 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 997 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNDEGLECVPTEESNITMQIMRITVPLSQGPKPVTISFANHTSCRCMSKLD

SEQ ID NO: 998 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 999 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNDEGLECVPTEESNITMQIMRITVPLSQGPKPVTISFANHTSCRCMSKLD

SEQ ID NO: 1000 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1001 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNDEGLECVPTEESNITMQIMRITVPLSQGPKPVTISFANHTSCRCMSKLD

SEQ ID NO: 1002 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1003 - protein, 104 aa, Artificial Sequence
  Growth Factor Hybrid Sequence
AHYNTEILKFMDVYQRSYCHPREVCIDVGKEFGVATNTFFKPPCVSVYRCGGCCNDEGLECVPTEESNITMQIMRITVPLSQGPKPVTISFANHTSCRCMSKLD

SEQ ID NO: 1004 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1005 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNDEGLECVPTEESNITMQIMRITVPLSQGPKPVTISFANHTSCRCMSKLD

SEQ ID NO: 1006 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1007 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNDEGLECVPTEESNITMQIMRITVPLSQGPKPVTISFANHTSCRCMSKLD

SEQ ID NO: 1008 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1009 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCVPTEESNITMQIMRITVPLSQGPKPVTISFANHTSCRCMSKLD

SEQ ID NO: 1010 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1011 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNSEGLQCVPTEESNITMQIMRITVPLSQGPKPVTISFANHTSCRCMSKLD

SEQ ID NO: 1012 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1013 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCVPTEESNITMQIMRITVPLSQGPKPVTISFANHTSCRCMSKLD

SEQ ID NO: 1014 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1015 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCVPTEESNITMQIMRITVPLSQGPKPVTISFANHTSCRCMSKLD

SEQ ID NO: 1016 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1017 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCVPTEESNITMQIMRITVPLSQGPKPVTISFANHTSCRCMSKLD

SEQ ID NO: 1018 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1019 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNSEGLQCVPTEESNITMQIMRITVPLSQGPKPVTISFANHTSCRCMSKLD

SEQ ID NO: 1020 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1021 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCVPTEESNITMQIMRITVPLSQGPKPVTISFANHTSCRCMSKLD

SEQ ID NO: 1022 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1023 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCVPTEESNITMQIMRITVPLSQGPKPVTISFANHTSCRCMSKLD

SEQ ID NO: 1024 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1025 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNSEGLQCVPTEESNITMQIMRITVPLSQGPKPVTISFANHTSCRCMSKLD

SEQ ID NO: 1026 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1027 - protein, 104 aa, Artificial Sequence
  Growth Factor Hybrid Sequence
AHYNTEILKFMDVYQRSYCHPIETLVDIFQEFGVATNTFFKPSCVPLMRCGGCCNSEGLQCVPTEESNITMQIMRITVPLSQGPKPVTISFANHTSCRCMSKLD

SEQ ID NO: 1028 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1029 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCVPTEESNITMQIMRITVPLSQGPKPVTISFANHTSCRCMSKLD

SEQ ID NO: 1030 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1031 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNSEGLQCVPTEESNITMQIMRITVPLSQGPKPVTISFANHTSCRCMSKLD

SEQ ID NO: 1032 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1033 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNSEGLQCVPTEESNITMQIMRITVPLSQGPKPVTISFANHTSCRCMSKLD

SEQ ID NO: 1034 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1035 - protein, 104 aa, Artificial Sequence
  Growth Factor Hybrid Sequence
AHYNTEILKFMDVYQRSYCHPREVCIDVGKEFGVATNTFFKPSCVPLMRCGGCCNSEGLQCVPTEESNITMQIMRITVPLSQGPKPVTISFANHTSCRCMSKLD

SEQ ID NO: 1036 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1037 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCVPTEESNITMQIMRITVPLSQGPKPVTISFANHTSCRCMSKLD

SEQ ID NO: 1038 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1039 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNSEGLQCVPTEESNITMQIMRITVPLSQGPKPVTISFANHTSCRCMSKLD

SEQ ID NO: 1040 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1041 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCVPTEESNITMQIMRITVPLSQGPKPVTISFANHTSCRCMSKLD

SEQ ID NO: 1042 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1043 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNSEGLQCVPTEESNITMQIMRITVPLSQGPKPVTISFANHTSCRCMSKLD

SEQ ID NO: 1044 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1045 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCVPTEESNITMQIMRITVPLSQGPKPVTISFANHTSCRCMSKLD

SEQ ID NO: 1046 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1047 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCVPTEESNITMQIMRITVPLSQGPKPVTISFANHTSCRCMSKLD

SEQ ID NO: 1048 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1049 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCVPTEESNITMQIMRITVPLSQGPKPVTISFANHTSCRCMSKLD

SEQ ID NO: 1050 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1051 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNSEGLQCVPTEESNITMQIMRITVPLSQGPKPVTISFANHTSCRCMSKLD

SEQ ID NO: 1052 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1053 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCVPTEESNITMQIMRITVPLSQGPKPVTISFANHTSCRCMSKLD

SEQ ID NO: 1054 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1055 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCVPTEESNITMQIMRITVPLSQGPKPVTISFANHTSCRCMSKLD

SEQ ID NO: 1056 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1057 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNSEGLQCVPTEESNITMQIMRITVPLSQGPKPVTISFANHTSCRCMSKLD

SEQ ID NO: 1058 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1059 - protein, 104 aa, Artificial Sequence
  Growth Factor Hybrid Sequence
AHYNTEILKFMDVYQRSYCHPIETLVDIFQEFGVATNTFFKPPCVSVYRCGGCCNSEGLQCVPTEESNITMQIMRITVPLSQGPKPVTISFANHTSCRCMSKLD

SEQ ID NO: 1060 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1061 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCVPTEESNITMQIMRITVPLSQGPKPVTISFANHTSCRCMSKLD

SEQ ID NO: 1062 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1063 - protein, 105 aa, Artificial Sequence; identical to SEQ ID NO: 159
  Growth Factor Hybrid Sequence

SEQ ID NO: 1064 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1065 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNSEGLQCVPTEESNITMQIMRITVPLSQGPKPVTISFANHTSCRCMSKLD

SEQ ID NO: 1066 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1067 - protein, 104 aa, Artificial Sequence
  Growth Factor Hybrid Sequence
AHYNTEILKFMDVYQRSYCHPREVCIDVGKEFGVATNTFFKPPCVSVYRCGGCCNSEGLQCVPTEESNITMQIMRITVPLSQGPKPVTISFANHTSCRCMSKLD

SEQ ID NO: 1068 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1069 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCVPTEESNITMQIMRITVPLSQGPKPVTISFANHTSCRCMSKLD

SEQ ID NO: 1070 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcgttcccaccgaggagtccaacatcaccatgcagattatgagaattacagtgcctctctctcaagggcccaaaccagtgacaatcagctttgccaatcacacttcctgccgatgcatgtctaagctggat

SEQ ID NO: 1071 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNSEGLQCVPTEESNITMQIMRITVPLSQGPKPVTISFANHTSCRCMSKLD

SEQ ID NO: 1072 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1073 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNDEGLECMNTSTSYLSKTLFEITVPLSQGPKPVTISFANHTSCRCMSKLD

SEQ ID NO: 1074 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1075 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNDEGLECMNTSTSYLSKTLFEITVPLSQGPKPVTISFANHTSCRCMSKLD

SEQ ID NO: 1076 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1077 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNDEGLECMNTSTSYLSKTLFEITVPLSQGPKPVTISFANHTSCRCMSKLD

SEQ ID NO: 1078 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1079 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNDEGLECMNTSTSYLSKTLFEITVPLSQGPKPVTISFANHTSCRCMSKLD

SEQ ID NO: 1080 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1081 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNDEGLECMNTSTSYLSKTLFEITVPLSQGPKPVTISFANHTSCRCMSKLD

SEQ ID NO: 1082 - DNA, 312 bp, Artificial Sequence; identical to SEQ ID NO: 1080
  Growth Factor Hybrid Sequence
  CDS (1)..(312)

SEQ ID NO: 1083 - protein, 104 aa, Artificial Sequence; identical to SEQ ID NO: 1081
  Growth Factor Hybrid Sequence

SEQ ID NO: 1084 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1085 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNDEGLECMNTSTSYLSKTLFEITVPLSQGPKPVTISFANHTSCRCMSKLD

SEQ ID NO: 1086 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1087 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNDEGLECMNTSTSYLSKTLFEITVPLSQGPKPVTISFANHTSCRCMSKLD

SEQ ID NO: 1088 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1089 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNDEGLECMNTSTSYLSKTLFEITVPLSQGPKPVTISFANHTSCRCMSKLD

SEQ ID NO: 1090 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1091 - protein, 104 aa, Artificial Sequence
  Growth Factor Hybrid Sequence
AHYNTEILKFMDVYQRSYCHPIETLVDIFQEFGVATNTFFKPSCVPLMRCGGCCNDEGLECMNTSTSYLSKTLFEITVPLSQGPKPVTISFANHTSCRCMSKLD

SEQ ID NO: 1092 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1093 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNDEGLECMNTSTSYLSKTLFEITVPLSQGPKPVTISFANHTSCRCMSKLD

SEQ ID NO: 1094 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1095 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNDEGLECMNTSTSYLSKTLFEITVPLSQGPKPVTISFANHTSCRCMSKLD

SEQ ID NO: 1096 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1097 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNDEGLECMNTSTSYLSKTLFEITVPLSQGPKPVTISFANHTSCRCMSKLD

SEQ ID NO: 1098 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1099 - protein, 104 aa, Artificial Sequence
  Growth Factor Hybrid Sequence
AHYNTEILKFMDVYQRSYCHPREVCIDVGKEFGVATNTFFKPSCVPLMRCGGCCNDEGLECMNTSTSYLSKTLFEITVPLSQGPKPVTISFANHTSCRCMSKLD

SEQ ID NO: 1100 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1101 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNDEGLECMNTSTSYLSKTLFEITVPLSQGPKPVTISFANHTSCRCMSKLD

SEQ ID NO: 1102 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1103 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNDEGLECMNTSTSYLSKTLFEITVPLSQGPKPVTISFANHTSCRCMSKLD

SEQ ID NO: 1104 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1105 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNDEGLECMNTSTSYLSKTLFEITVPLSQGPKPVTISFANHTSCRCMSKLD

SEQ ID NO: 1106 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1107 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNDEGLECMNTSTSYLSKTLFEITVPLSQGPKPVTISFANHTSCRCMSKLD

SEQ ID NO: 1108 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1109 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNDEGLECMNTSTSYLSKTLFEITVPLSQGPKPVTISFANHTSCRCMSKLD

SEQ ID NO: 1110 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1111 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNDEGLECMNTSTSYLSKTLFEITVPLSQGPKPVTISFANHTSCRCMSKLD

SEQ ID NO: 1112 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1113 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNDEGLECMNTSTSYLSKTLFEITVPLSQGPKPVTISFANHTSCRCMSKLD

SEQ ID NO: 1114 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1115 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNDEGLECMNTSTSYLSKTLFEITVPLSQGPKPVTISFANHTSCRCMSKLD

SEQ ID NO: 1116 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1117 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNDEGLECMNTSTSYLSKTLFEITVPLSQGPKPVTISFANHTSCRCMSKLD

SEQ ID NO: 1118 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1119 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNDEGLECMNTSTSYLSKTLFEITVPLSQGPKPVTISFANHTSCRCMSKLD

SEQ ID NO: 1120 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1121 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNDEGLECMNTSTSYLSKTLFEITVPLSQGPKPVTISFANHTSCRCMSKLD

SEQ ID NO: 1122 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1123 - protein, 104 aa, Artificial Sequence
  Growth Factor Hybrid Sequence
AHYNTEILKFMDVYQRSYCHPIETLVDIFQEFGVATNTFFKPPCVSVYRCGGCCNDEGLECMNTSTSYLSKTLFEITVPLSQGPKPVTISFANHTSCRCMSKLD

SEQ ID NO: 1124 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1125 - protein, 105 aa, Artificial Sequence; identical to SEQ ID NO: 157
  Growth Factor Hybrid Sequence

SEQ ID NO: 1126 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1127 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNDEGLECMNTSTSYLSKTLFEITVPLSQGPKPVTISFANHTSCRCMSKLD

SEQ ID NO: 1128 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1129 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNDEGLECMNTSTSYLSKTLFEITVPLSQGPKPVTISFANHTSCRCMSKLD

SEQ ID NO: 1130 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1131 - protein, 104 aa, Artificial Sequence
  Growth Factor Hybrid Sequence
AHYNTEILKFMDVYQRSYCHPREVCIDVGKEFGVATNTFFKPPCVSVYRCGGCCNDEGLECMNTSTSYLSKTLFEITVPLSQGPKPVTISFANHTSCRCMSKLD

SEQ ID NO: 1132 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1133 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNDEGLECMNTSTSYLSKTLFEITVPLSQGPKPVTISFANHTSCRCMSKLD

SEQ ID NO: 1134 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatgacgaagggctggagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1135 - protein, 105 aa, Artificial Sequence
  Growth Factor Hybrid Sequence
AHYNTEILKSIDNEWRKTQCMPREVCIDVGKEFGVATNTFFKPPCVSVYRCGGCCNDEGLECMNTSTSYLSKTLFEITVPLSQGPKPVTISFANHTSCRCMSKLD

SEQ ID NO: 1136 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1137 - protein, 104 aa, Artificial Sequence
  Growth Factor Hybrid Sequence
GQNHHEVVKFMDVYQRSYCHPIETLVDIFQEYPDEIEYIFKPSCVPLMRCGGCCNSEGLQCMNTSTSYLSKTLFEITVPLSQGPKPVTISFANHTSCRCMSKLD

SEQ ID NO: 1138 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1139 - protein, 104 aa, Artificial Sequence
  Growth Factor Hybrid Sequence
AHYNTEILKFMDVYQRSYCHPIETLVDIFQEYPDEIEYIFKPSCVPLMRCGGCCNSEGLQCMNTSTSYLSKTLFEITVPLSQGPKPVTISFANHTSCRCMSKLD

SEQ ID NO: 1140 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1141 - protein, 105 aa, Artificial Sequence
  Growth Factor Hybrid Sequence
GQNHHEVVKSIDNEWRKTQCMPIETLVDIFQEYPDEIEYIFKPSCVPLMRCGGCCNSEGLQCMNTSTSYLSKTLFEITVPLSQGPKPVTISFANHTSCRCMSKLD

SEQ ID NO: 1142 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1143 - protein, 105 aa, Artificial Sequence
  Growth Factor Hybrid Sequence
AHYNTEILKSIDNEWRKTQCMPIETLVDIFQEYPDEIEYIFKPSCVPLMRCGGCCNSEGLQCMNTSTSYLSKTLFEITVPLSQGPKPVTISFANHTSCRCMSKLD

SEQ ID NO: 1144 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1145 - protein, 104 aa, Artificial Sequence
  Growth Factor Hybrid Sequence
GQNHHEVVKFMDVYQRSYCHPREVCIDVGKEYPDEIEYIFKPSCVPLMRCGGCCNSEGLQCMNTSTSYLSKTLFEITVPLSQGPKPVTISFANHTSCRCMSKLD

SEQ ID NO: 1146 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1147 - protein, 104 aa, Artificial Sequence
  Growth Factor Hybrid Sequence
AHYNTEILKFMDVYQRSYCHPREVCIDVGKEYPDEIEYIFKPSCVPLMRCGGCCNSEGLQCMNTSTSYLSKTLFEITVPLSQGPKPVTISFANHTSCRCMSKLD

SEQ ID NO: 1148 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1149 - protein, 105 aa, Artificial Sequence
  Growth Factor Hybrid Sequence
GQNHHEVVKSIDNEWRKTQCMPREVCIDVGKEYPDEIEYIFKPSCVPLMRCGGCCNSEGLQCMNTSTSYLSKTLFEITVPLSQGPKPVTISFANHTSCRCMSKLD

SEQ ID NO: 1150 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1151 - protein, 105 aa, Artificial Sequence
  Growth Factor Hybrid Sequence
AHYNTEILKSIDNEWRKTQCMPREVCIDVGKEYPDEIEYIFKPSCVPLMRCGGCCNSEGLQCMNTSTSYLSKTLFEITVPLSQGPKPVTISFANHTSCRCMSKLD

SEQ ID NO: 1152 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1153 - protein, 104 aa, Artificial Sequence
  Growth Factor Hybrid Sequence
GQNHHEVVKFMDVYQRSYCHPIETLVDIFQEFGVATNTFFKPSCVPLMRCGGCCNSEGLQCMNTSTSYLSKTLFEITVPLSQGPKPVTISFANHTSCRCMSKLD

SEQ ID NO: 1154 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1155 - protein, 104 aa, Artificial Sequence
  Growth Factor Hybrid Sequence
AHYNTEILKFMDVYQRSYCHPIETLVDIFQEFGVATNTFFKPSCVPLMRCGGCCNSEGLQCMNTSTSYLSKTLFEITVPLSQGPKPVTISFANHTSCRCMSKLD

SEQ ID NO: 1156 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1157 - protein, 105 aa, Artificial Sequence
  Growth Factor Hybrid Sequence
GQNHHEVVKSIDNEWRKTQCMPIETLVDIFQEFGVATNTFFKPSCVPLMRCGGCCNSEGLQCMNTSTSYLSKTLFEITVPLSQGPKPVTISFANHTSCRCMSKLD

SEQ ID NO: 1158 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1159 - protein, 105 aa, Artificial Sequence
  Growth Factor Hybrid Sequence
AHYNTEILKSIDNEWRKTQCMPIETLVDIFQEFGVATNTFFKPSCVPLMRCGGCCNSEGLQCMNTSTSYLSKTLFEITVPLSQGPKPVTISFANHTSCRCMSKLD

SEQ ID NO: 1160 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1161 - protein, 104 aa, Artificial Sequence
  Growth Factor Hybrid Sequence
GQNHHEVVKFMDVYQRSYCHPREVCIDVGKEFGVATNTFFKPSCVPLMRCGGCCNSEGLQCMNTSTSYLSKTLFEITVPLSQGPKPVTISFANHTSCRCMSKLD

SEQ ID NO: 1162 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1163 - protein, 104 aa, Artificial Sequence
  Growth Factor Hybrid Sequence
AHYNTEILKFMDVYQRSYCHPREVCIDVGKEFGVATNTFFKPSCVPLMRCGGCCNSEGLQCMNTSTSYLSKTLFEITVPLSQGPKPVTISFANHTSCRCMSKLD

SEQ ID NO: 1164 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1165 - protein, 105 aa, Artificial Sequence
  Growth Factor Hybrid Sequence
GQNHHEVVKSIDNEWRKTQCMPREVCIDVGKEFGVATNTFFKPSCVPLMRCGGCCNSEGLQCMNTSTSYLSKTLFEITVPLSQGPKPVTISFANHTSCRCMSKLD

SEQ ID NO: 1166 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccatcctgcgtgcccctgatgagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1167 - protein, 105 aa, Artificial Sequence
  Growth Factor Hybrid Sequence
AHYNTEILKSIDNEWRKTQCMPREVCIDVGKEFGVATNTFFKPSCVPLMRCGGCCNSEGLQCMNTSTSYLSKTLFEITVPLSQGPKPVTISFANHTSCRCMSKLD

SEQ ID NO: 1168 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1169 - protein, 104 aa, Artificial Sequence
  Growth Factor Hybrid Sequence
GQNHHEVVKFMDVYQRSYCHPIETLVDIFQEYPDEIEYIFKPPCVSVYRCGGCCNSEGLQCMNTSTSYLSKTLFEITVPLSQGPKPVTISFANHTSCRCMSKLD

SEQ ID NO: 1170 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1171 - protein, 104 aa, Artificial Sequence
  Growth Factor Hybrid Sequence
AHYNTEILKFMDVYQRSYCHPIETLVDIFQEYPDEIEYIFKPPCVSVYRCGGCCNSEGLQCMNTSTSYLSKTLFEITVPLSQGPKPVTISFANHTSCRCMSKLD

SEQ ID NO: 1172 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1173 - protein, 105 aa, Artificial Sequence
  Growth Factor Hybrid Sequence
GQNHHEVVKSIDNEWRKTQCMPIETLVDIFQEYPDEIEYIFKPPCVSVYRCGGCCNSEGLQCMNTSTSYLSKTLFEITVPLSQGPKPVTISFANHTSCRCMSKLD

SEQ ID NO: 1174 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1175 - protein, 105 aa, Artificial Sequence
  Growth Factor Hybrid Sequence
AHYNTEILKSIDNEWRKTQCMPIETLVDIFQEYPDEIEYIFKPPCVSVYRCGGCCNSEGLQCMNTSTSYLSKTLFEITVPLSQGPKPVTISFANHTSCRCMSKLD

SEQ ID NO: 1176 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1177 - protein, 104 aa, Artificial Sequence
  Growth Factor Hybrid Sequence
GQNHHEVVKFMDVYQRSYCHPREVCIDVGKEYPDEIEYIFKPPCVSVYRCGGCCNSEGLQCMNTSTSYLSKTLFEITVPLSQGPKPVTISFANHTSCRCMSKLD

SEQ ID NO: 1178 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1179 - protein, 104 aa, Artificial Sequence
  Growth Factor Hybrid Sequence
AHYNTEILKFMDVYQRSYCHPREVCIDVGKEYPDEIEYIFKPPCVSVYRCGGCCNSEGLQCMNTSTSYLSKTLFEITVPLSQGPKPVTISFANHTSCRCMSKLD

SEQ ID NO: 1180 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1181 - protein, 105 aa, Artificial Sequence
  Growth Factor Hybrid Sequence
GQNHHEVVKSIDNEWRKTQCMPREVCIDVGKEYPDEIEYIFKPPCVSVYRCGGCCNSEGLQCMNTSTSYLSKTLFEITVPLSQGPKPVTISFANHTSCRCMSKLD

SEQ ID NO: 1182 - DNA, 315 bp, Artificial Sequence
  Growth Factor Hybrid Sequence
  CDS (1)..(315)
gcacattataataccgagatcctgaaatctattgataatgagtggagaaagactcagtgcatgccgagagaggtgtgtatcgacgtggggaaggaataccctgatgagatcgagtacatcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1183 - protein, 105 aa, Artificial Sequence
  Growth Factor Hybrid Sequence
AHYNTEILKSIDNEWRKTQCMPREVCIDVGKEYPDEIEYIFKPPCVSVYRCGGCCNSEGLQCMNTSTSYLSKTLFEITVPLSQGPKPVTISFANHTSCRCMSKLD

SEQ ID NO: 1184 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1185 - protein, 104 aa, Artificial Sequence
  Growth Factor Hybrid Sequence
GQNHHEVVKFMDVYQRSYCHPIETLVDIFQEFGVATNTFFKPPCVSVYRCGGCCNSEGLQCMNTSTSYLSKTLFEITVPLSQGPKPVTISFANHTSCRCMSKLD

SEQ ID NO: 1186 - DNA, 312 bp, Artificial Sequence
  Growth Factor Hybrid Sequence
  CDS (1)..(312)
gcacattataataccgagatcctgaaattcatggatgtctatcagcgcagctactgccatccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1187 - protein, 104 aa, Artificial Sequence
  Growth Factor Hybrid Sequence
AHYNTEILKFMDVYQRSYCHPIETLVDIFQEFGVATNTFFKPPCVSVYRCGGCCNSEGLQCMNTSTSYLSKTLFEITVPLSQGPKPVTISFANHTSCRCMSKLD

SEQ ID NO: 1188 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1189 - protein, 105 aa, Artificial Sequence
  Growth Factor Hybrid Sequence
GQNHHEVVKSIDNEWRKTQCMPIETLVDIFQEFGVATNTFFKPPCVSVYRCGGCCNSEGLQCMNTSTSYLSKTLFEITVPLSQGPKPVTISFANHTSCRCMSKLD

SEQ ID NO: 1190 - DNA, 315 bp, Artificial Sequence
  Growth Factor Hybrid Sequence
  CDS (1)..(315)
gcacattataataccgagatcctgaaatctattgataatgagtggagaaagactcagtgcatgccgatcgagacactggtggacatcttccaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1191 - protein, 105 aa, Artificial Sequence
  Growth Factor Hybrid Sequence
AHYNTEILKSIDNEWRKTQCMPIETLVDIFQEFGVATNTFFKPPCVSVYRCGGCCNSEGLQCMNTSTSYLSKTLFEITVPLSQGPKPVTISFANHTSCRCMSKLD

SEQ ID NO: 1192 - DNA, 312 bp, Artificial Sequence
  Growth Factor Hybrid Sequence
  CDS (1)..(312)
gggcagaatcatcacgaagtggtgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1193 - protein, 104 aa, Artificial Sequence
  Growth Factor Hybrid Sequence
GQNHHEVVKFMDVYQRSYCHPREVCIDVGKEFGVATNTFFKPPCVSVYRCGGCCNSEGLQCMNTSTSYLSKTLFEITVPLSQGPKPVTISFANHTSCRCMSKLD

SEQ ID NO: 1194 - DNA, 312 bp, Artificial Sequence
  Growth Factor Hybrid Sequence
  CDS (1)..(312)
gcacattataataccgagatcctgaaattcatggatgtctatcagcgcagctactgccatccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1195 - protein, 104 aa, Artificial Sequence
  Growth Factor Hybrid Sequence
AHYNTEILKFMDVYQRSYCHPREVCIDVGKEFGVATNTFFKPPCVSVYRCGGCCNSEGLQCMNTSTSYLSKTLFEITVPLSQGPKPVTISFANHTSCRCMSKLD

SEQ ID NO: 1196 - DNA, 315 bp, Artificial Sequence
  Growth Factor Hybrid Sequence
  CDS (1)..(315)
gggcagaatcatcacgaagtggtgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1197 - protein, 105 aa, Artificial Sequence
  Growth Factor Hybrid Sequence
GQNHHEVVKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLD

SEQ ID NO: 1198 - DNA, 315 bp, Homo sapiens
  CDS (1)..(315)
gcacattataataccgagatcctgaaatctattgataatgagtggagaaagactcagtgcatgccgagagaggtgtgtatcgacgtggggaaggaatttggagtcgcgacaaacaccttcttcaagccaccatgtgtgtccgtgtacagatgtgggggttgctgcaatagtgaggggctgcagtgcatgaacacgtccacgagctacctcagcaagacgctgtttgaaattacagtgcctctctctcaagggcccaaaccagtgacaatcagctttgccaatcacacttcctgccgatgcatgtctaagctggat

SEQ ID NO: 1199 - protein, 105 aa, Homo sapiens
AHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLD

SEQ ID NO: 1200 - protein, 13 aa, Artificial sequence
  PDGF motif
  misc_feature (2)..(2): Xaa = Proline or Serine
  misc_feature (5)..(7): Xaa = any or unknown amino acid
  misc_feature (10)..(10): Xaa = Arginine, Serine, Threonine or Alanine
PXCVXXXRCXGCC

SEQ ID NO: 1201 - protein, 87 aa, Artificial sequence
  VEGF Homology Domain Motif
  misc_feature (2)..(23): Xaa = any or unknown amino acid
  misc_feature (24)..(25)Xaa = any amino acid or unknown amino acid or nothing
  misc_feature (27)..(27): Xaa = Proline, Serine or Arginine
  misc_feature (30)..(32): Xaa = any or unknown amino acid
  misc_feature (35)..(35): Xaa = Glycine, Serine, Threonine or Alanine
  misc_feature (39)..(44): Xaa = any or unknown amino acid
  misc_feature (46)..(77): Xaa = any or unknown amino acid
  misc_feature (78)..(86): Xaa = any amino acid or unknown amino acid or nothing
CXXXXXXXXXXXXXXXXXXXXXXXXPXCVXXXRCXGCCXXXXXXCXXXXXXXXXXXXXXXXXXXXXXXXXXXXXXXXXXXXXXXXXC

SEQ ID NO: 1202 - protein, 102 aa, Artificial sequence
  VEGF/PDGF homology domain motif
  misc_feature (2)..(19): Xaa = any or unknown amino acid
  misc_feature (20)..(29): Xaa = any amino acid or unknown amino acid or nothing
  misc_feature (31)..(31): Xaa = any or unknown amino acid
  misc_feature (33)..(36): Xaa = any or unknown amino acid
  misc_feature (39)..(39): Xaa = any or unknown amino acid
  misc_feature (42)..(42): Xaa = Cysteine or nothing
  misc_feature (43)..(48): Xaa = any or unknown amino acid
  misc_feature (49)..(54): Xaa = Xaa = any amino acid or unknown amino acid or nothing
  misc_feature (56)..(85): Xaa = any or unknown amino acid
  misc_feature (86)..(101): Xaa = any amino acid or unknown amino acid or nothing
CXXXXXXXXXXXXXXXXXXXXXXXXXXXXPXCXXXXRCXGCXXXXXXXXXXXXXCXXXXXXXXXXXXXXXXXXXXXXXXXXXXXXXXXXXXXXXXXXXXXXC

SEQ ID NO: 1203 - protein, 87 aa, Artificial sequence; identical to SEQ ID NO: 1201
  VEGF/PDGF homology domain motif
  misc_feature (2)..(23): Xaa = any or unknown amino acid
  misc_feature (24)..(25): Xaa = any amino acid or nothing
  misc_feature (27)..(27): Xaa = Proline, Serine or Arginine
  misc_feature (30)..(32): Xaa = any or unknown amino acid
  misc_feature (35)..(35): Xaa = any or unknown amino acid
  misc_feature (39)..(44): Xaa = any or unknown amino acid
  misc_feature (46)..(77): Xaa = any or unknown amino acid
  misc_feature (78)..(86): Xaa = any amino acid or unknown amino acid or nothing

SEQ ID NO: 1204 - protein, 8 aa, Artificial sequence
  VEGF-C fragment
  misc_feature (5)..(7): Xaa = any or unknown amino acid
TNTFXXXP

SEQ ID NO: 1205 - protein, 21 aa, Artificial sequence
  VEGF-C fragment
EFGVATNTFFKPPCVSVYRCG

SEQ ID NO: 1206 - protein, 8 aa, Artificial sequence
  VEGF-C fragment
TNTFFKPP

SEQ ID NO: 1207 - protein, 14 aa, Artificial sequence
  VEGF-C fragment
  misc_feature (11)..(13): Xaa = any or unknown amino acid
TNTFFKPPCVXXXR

SEQ ID NO: 1208 - protein, 19 aa, Artificial sequence
  VEGF-C fragment
  misc_feature (11)..(13): Xaa = any or unknown amino acid
TNTFFKPPCVXXXRCGGCC

SEQ ID NO: 1209 - protein, 102 aa, Artificial sequence [sequence omitted]

SEQ ID NO: 1210 - protein, 105 aa, Artificial sequence; identical to SEQ ID NO: 1199
  VEGF residues

SEQ ID NO: 1211 - protein, 8 aa, Artificial sequence
  VEGF-A fragment
  misc_feature (5)..(7): Xaa = any or unknown amino acid
IEYIXXXS

SEQ ID NO: 1212 - protein, 12 aa, Artificial sequence
  VEGF-C fragment
  misc_feature (5)..(5): Xaa = any amino acid or unknown amino acid
  misc_feature (6)..(11): Xaa = any amino acid or unknown amino acid or nothing
TNTFXXXXXXXP

What is claimed is:

1. A polynucleotide comprising a nucleotide sequence that encodes a polypeptide comprising an amino acid sequence that is at least 95% identical to a chimeric vascular endothelial growth factor (VEGF) amino acid sequence of the formula:

$$NH_2\text{-}X_1\text{-}X_2\text{-}X_3\text{-}X_4\text{-}X_5\text{-}X_6\text{-}X_7\text{-}X_8\text{-}X_9\text{-}COOH$$

wherein $X_1$ is an amino acid sequence selected from the group consisting of amino acids 3-11 of SEQ ID NO: 128 and amino acids 3-11 of SEQ ID NO: 137;

wherein $X_2$ is an amino acid sequence selected from the group consisting of SEQ ID NOs: 129 and 138;

wherein $X_3$ is an amino acid sequence selected from the group consisting of SEQ ID NOs: 130 and 139;

wherein $X_4$ is an amino acid sequence selected from the group consisting of SEQ ID NOs: 131 and 140;

wherein $X_5$ is an amino acid sequence selected from the group consisting of SEQ ID NOs: 132 and 141;

wherein $X_6$ is an amino acid sequence selected from the group consisting of SEQ ID NOs: 133 and 142;

wherein $X_7$ is an amino acid sequence selected from the group consisting of SEQ ID NOs: 134 and 143;

wherein $X_8$ is an amino acid sequence selected from the group consisting of SEQ ID NOs: 135 and 144;

wherein $X_9$ is an amino acid sequence selected from the group consisting of SEQ ID NOs: 136 and 145;

wherein the chimeric VEGF binds to at least one receptor selected from the group consisting of human VEGFR-1, human VEGFR-2, and human VEGFR-3; and wherein the polypeptide binds to at least one receptor selected from the group consisting of human VEGFR-1, human VEGFR-2, and human VEGFR-3.

2. A polynucleotide according to claim 1, wherein the encoded polypeptide further includes a signal peptide amino acid sequence connected to the amino acid sequence of the formula $NH_2\text{-}X_1\text{-}X_2\text{-}X_3\text{-}X_4\text{-}X_5\text{-}X_6\text{-}X_7\text{-}X_8\text{-}X_9\text{-}COOH$.

3. A polynucleotide according to claim 1, wherein the encoded polypeptide further includes an amino-terminal methionine residue.

4. A polynucleotide according to claim 1, wherein the encoded polypeptide further includes a tag amino acid sequence connected to the-amino acid sequence of the formula $NH_2\text{-}X_1\text{-}X_2\text{-}X_3\text{-}X_4\text{-}X_5\text{-}X_6\text{-}X_7\text{-}X_8\text{-}X_9\text{-}COOH$.

5. A polynucleotide according to claim 1, wherein the encoded polypeptide further includes one or more amino acid sequences selected from the group consisting of a prepro-VEGF-C signal peptide, a prepro-VEGF-C amino-terminal propeptide, and a prepro-VEGF-C carboxy-terminal pro-peptide.

6. A polynucleotide according to claim 1, wherein the encoded polypeptide further includes an amino terminal sequence selected from the group consisting of amino acids 1-34 of SEQ ID NO: 2, amino acids 1-111 of SEQ ID NO: 22, amino acids 1-34 of SEQ ID NO: 147, and fragments thereof; and wherein the encoded polypeptide further includes a carboxy terminal sequence selected from the group consisting of amino acids 136-191 of SEQ ID NO: 2, amino acids 217-419 of SEQ ID NO: 22, amino acids 136-232 of SEQ ID NO: 147, and fragments thereof.

7. A composition comprising a polynucleotide according to claim 1 in a pharmaceutically acceptable carrier.

8. A polynucleotide according to claim 1, wherein $X_4$ is SEQ ID NO: 140, and wherein the encoded polypeptide binds to VEGFR-3.

9. A polynucleotide according to claim 8, wherein $X_5$ is SEQ ID NO: 144.

10. A polynucleotide according to claim 1, wherein $X_2$ is SEQ ID NO: 129, and wherein the encoded polypeptide binds to VEGFR-1.

11. A polynucleotide according to claim 10, wherein $X_7$ is SEQ ID NO: 134.

12. A polynucleotide according to claim 10, wherein $X_4$ is SEQ ID NO: 140, and wherein the encoded polypeptide binds to VEGFR-3.

13. A polynucleotide according to claim 1, wherein the encoded polypeptide binds to human VEGFR-1 and VEGFR-3.

14. A polynucleotide according to claim 1, wherein the encoded polypeptide binds to human VEGFR-1, VEGFR-2, and VEGFR-3.

15. The polynucleotide of claim 1, wherein the amino acid sequence of the encoded polypeptide further comprises a sequence selected from the group consisting of amino acids 136-191 of SEQ ID NO: 2, amino, acids 217-419 of SEQ ID NO: 22, amino acids 136-232 of SEQ ID NO: 147, and fragments thereof.

16. The polynucleotide of claim 1, wherein the encoded polypeptide further includes additional flanking sequence from VEGF-A (SEQ ID NO: 2) or VEGF-C (SEQ ID NO: 22).

17. An expression vector comprising an expression control sequence operatively linked to the polynucleotide according to claim 1.

18. An expression vector according to claim 17, wherein the expression control sequence comprises a promoter that promotes expression in a mammalian cell.

19. An isolated host cell transformed or transfected with a vector according to claim 18.

20. A method for producing a polypeptide that binds at least one human vascular endothelial growth factor receptor selected from the group consisting of VEGFR-1, VEGFR-2, and VEGFR-3, comprising:

growing a host cell according to claim 19 under conditions in which the cell expresses the polypeptide encoded by the polynucleotide.

21. The method of claim 20 further comprising the step of isolating the polypeptide from the cell or medium.

22. A polynucleotide comprising a nucleotide sequence that encodes a polypeptide comprising an amino acid sequence at least 95% identical to the amino acid sequence of SEQ ID NO: 175, wherein said polypeptide binds at least one human receptor selected from the group consisting of VEGFR-1, VEGFR-2, and VEGFR-3.

23. A polynucleotide according to claim 22, wherein the encoded polypeptide binds to human VEGFR-1, VEGFR-2, and VEGFR-3.

24. The polynucleotide of claim 23, wherein the amino acid sequence of the encoded polypeptide further includes additional flanking sequence from VEGF-A (SEQ ID NO: 2) or VEGF-C (SEQ ID NO: 22).

25. The polynucleotide of claim 22, wherein the amino acid sequence of the encoded polypeptide further comprises a sequence selected from the group consisting of amino acids 136-191 of SEQ ID NO: 2, amino acids 217-419 of SEQ ID NO: 22, amino acids 136-232 of SEQ ID NO: 147, and fragments thereof.

26. A polynucleotide according to claim 22, wherein the encoded polypeptide further includes an amino terminal sequence selected from the group consisting of amino acids 1-34 of SEQ ID NO: 2, amino acids 1-111 of SEQ ID NO: 22, amino acids 1-34 of SEQ ID NO: 147, and fragments thereof; and wherein the encoded polypeptide further includes a carboxy terminal sequence selected from the group consisting of amino acids 136-191 of SEQ ID NO: 2, amino acids 217-419 of SEQ ID NO: 22, amino acids 136-232 of SEQ ID NO: 147, and fragments thereof.

27. The polynucleotide of claim 22, wherein the amino acid of the encoded polypeptide further includes additional flanking sequence from VEGF-A (SEQ ID NO: 2) or VEGF-C (SEQ ID NO: 22).

28. An expression vector comprising an expression control sequence operatively linked to the polynucleotide according to claim 22.

29. An expression vector according to claim 28, wherein the expression control sequence comprises a promoter that promotes expression in a mammalian cell.

30. An isolated host cell transformed or transfected with a vector according to claim 29.

31. A method for producing a polypeptide that binds at least one human vascular endothelial growth factor receptor selected from the group consisting of VEGFR-1, VEGFR-2, and VEGFR-3, comprising:

growing a host cell according to claim 30 under conditions in which the cell expresses the polypeptide encoded by the polynucleotide.

32. The method of claim 31 further comprising the step of isolating the polypeptide from the cell or medium.

33. A polynucleotide comprising a nucleotide sequence at least 95% identical to a nucleotide sequence of the formula:

$$5'\text{-}N_1\text{-}N_2\text{-}N_3\text{-}N_4\text{-}N_5\text{-}N_6\text{-}N_7\text{-}N_8\text{-}N_9\text{-}3'$$

wherein $N_1$ is a nucleotide sequence selected from the group consisting of nucleotides 7-34 of SEQ ID NO: 3 and nucleotides 7-34 of SEQ ID NO: 23;

wherein $N_2$ is a nucleotide sequence selected from the group consisting of nucleotides 1-32 of SEQ ID NO: 4 and nucleotides 1-35 of SEQ ID NO: 24;

wherein $N_3$ is a nucleotide sequence selected from the group consisting of nucleotides 1-31 of SEQ ID NO: 5 and nucleotides 1-31 of SEQ ID NO: 25;

wherein $N_4$ is a nucleotide sequence selected from the group consisting of nucleotides 10-33 of SEQ ID NO: 6 and nucleotides 10-33 of SEQ ID NO: 26;

wherein $N_5$ is a nucleotide sequence selected from the group consisting of nucleotides 1-37 of SEQ ID NO: 7 and nucleotides 1-37 of SEQ ID NO: 27;

wherein $N_6$ is a nucleotide sequence selected from the group consisting of nucleotides 3-28 of SEQ ID NO: 8 and nucleotides 3-28 of SEQ ID NO: 28;

wherein $N_7$ is a nucleotide sequence selected from the group consisting of nucleotides 1-46 of SEQ ID NO: 9 and nucleotides 1-46 of SEQ ID NO: 29;

wherein $N_8$ is a nucleotide sequence selected from the group consisting of nucleotides 1-43 of SEQ ID NO: 10 and nucleotides 1-49 of SEQ ID NO: 30;

wherein $N_9$ is a nucleotide sequence selected from the group consisting of nucleotides 1-39 of SEQ ID NO: 11 and nucleotides 1-39 of SEQ ID NO: 31;

wherein $5'\text{-}N_1\text{-}N_2\text{-}N_3\text{-}N_4\text{-}N_5\text{-}N_6\text{-}N_7\text{-}N_8\text{-}N_9\text{-}3'$ is not identical to nucleotides 156 to 461 of SEQ ID NO: 1 or nucleotides 685 to 999 of SEQ ID NO: 21; and wherein the nucleotide sequence encodes a polypeptide that binds to at least one receptor selected from the group consisting of human VEGFR-1, human VEGFR-2, and human VEGFR-3.

34. The polynucleotide of claim 33, wherein the encoded polypeptide is a chimeric vascular endothelial growth factor (VEGF) derived from human VEGF-A (SEQ ID NO: 2) and human VEGF-C (SEQ ID NO: 22), wherein at least 95% of the residues of the polypeptide are identical to residues of the human VEGF-A or the human VEGF-C when the polypeptide and the human VEGF-A and the human VEGF-C are aligned.

35. The polynucleotide of claim 34, wherein the encoded polypeptide binds to human VEGFR-1, human VEGFR-2, and human VEGFR-3.

36. A polynucleotide according to claim 34, wherein $N_4$ is nucleotides 10-33 of SEQ ID NO: 26, and wherein the encoded polypeptide binds to VEGFR-3.

37. A polynucleotide according to claim 36, wherein $N_8$ is nucleotides 1-49 of SEQ ID NO: 30.

38. A polynucleotide according to claim 34, wherein $N_2$ is nucleotides 1-32 of SEQ ID NO: 4, and wherein the encoded polypeptide binds to VEGFR-1.

39. A polynucleotide according to claim 38, wherein $N_7$ is nucleotides 1-46 of SEQ ID NO: 9.

40. A polynucleotide according to claim 33, wherein $N_4$ is nucleotides 10-33 of SEQ ID NO: 26, and wherein the encoded polypeptide binds to VEGFR-3.

41. A polynucleotide according to claim 33 or 34, wherein the encoded polypeptide further includes a signal peptide amino acid sequence.

42. A polynucleotide according to claim 33 or 34, wherein the encoded polypeptide further includes an amino-terminal methionine residue.

43. A polynucleotide according to claim 33 or 34, wherein the encoded polypeptide further includes a tag amino acid sequence.

44. A polynucleotide according to claim 33 or 34, wherein the encoded polypeptide further includes one or more amino acid sequences selected from the group consisting of a prepro-VEGF-C signal peptide, a prepro-VEGF-C amino-terminal propeptide, and a prepro-VEGF-C carboxy-terminal pro-peptide.

45. A polynucleotide according to claim 33 or 34, wherein the encoded polypeptide further comprises an amino terminal amino acid sequence selected from the group consisting of amino acids 1-34 of SEQ ID NO: 2, amino acids 1-111 of SEQ ID NO: 22, amino acids 1-34 of SEQ ID NO: 147, and fragments thereof; and wherein the encoded polypeptide further comprises a carboxy terminal amino acid sequence selected from the group consisting of amino acids 136-191 of SEQ ID NO: 2, amino acids 217-419 of SEQ ID NO: 22, amino acids 136-232 of SEQ ID NO: 147, and fragments thereof.

46. A composition comprising a polynucleotide according to claim 33 or 34 in a pharmaceutically acceptable carrier.

47. The polynucleotide of claim 33, wherein the polypeptide further includes additional flanking sequence from VEGF-A (SEQ ID NO: 2) or VEGF-C (SEQ ID NO: 22).

48. An expression vector comprising an expression control sequence operatively linked to the polynucleotide according to claim 33.

49. An expression vector according to claim 48, wherein the expression control sequence comprises a promoter that promotes expression in a mammalian cell.

50. An isolated host cell transformed or transfected with a vector according to claim 49.

51. A method for producing a polypeptide that binds at least one human vascular endothelial growth factor receptor selected from the group consisting of VEGFR-1, VEGFR-2, and VEGFR-3, comprising:

growing a host cell according to claim 50 under conditions in which the cell expresses the polypeptide encoded by the polynucleotide.

52. The method of claim 51 further comprising the step of isolating the polypeptide from the cell or medium.

53. A polynucleotide comprising a nucleotide sequence that encodes a polypeptide comprising an amino acid sequence selected from the group consisting of amino acids 1-102 as set forth in SEQ ID NO: 51; amino acids 1-102 as set forth in SEQ ID NO: 59; amino acids 1-102 as set forth in SEQ ID NO: 63; amino acids 1-104 as set forth in SEQ ID NO: 67; amino acids 1-104 as set forth in SEQ ID NO: 71; amino acids 1-104 as set forth in SEQ ID NO: 75; amino acids 1-104 as set forth in SEQ ID NO: 77; amino acids 1-104 as set forth in SEQ ID NO: 153; amino acids 1-105 as set forth in SEQ ID NO: 155; amino acids 1-105 as set forth in SEQ ID NO: 157; amino acids 1-105 as set forth in SEQ ID NO: 159; amino acids 1-103 as set forth in SEQ ID NO: 161; amino acids 1-102 as set forth in SEQ ID NO: 163; amino acids 1-104 as set forth in SEQ ID NO: 165; amino acids 1-104 as set forth in SEQ ID NO: 167; amino acids 1-104 as set forth in SEQ ID NO: 169; amino acids 1-104 as set forth in SEQ ID NO: 171; amino acids 1-104 as set forth in SEQ ID NO: 173; and amino acids 1-104 as set forth in SEQ ID NO: 175.

54. The polynucleotide of claim 53, wherein the encoded polypeptide further includes an additional flanking sequence from VEGF-A (SEQ ID NO: 2) or VEGF-C (SEQ ID NO: 22).

55. A polynucleotide comprising a nucleotide sequence that encodes a polypeptide that binds human vascular endothelial growth factor receptors VEGFR-1, VEGFR-2, and VEGFR-3, wherein the polypeptide comprises an amino acid sequence selected from the group consisting of:

amino acids 1-102 of SEQ ID NO: 51; amino acids 1-102 of SEQ ID NO: 63; amino acids 1-104 of SEQ ID NO: 71; amino acids 1-104 of SEQ ID NO: 153; amino acids 1-103 of SEQ ID NO: 161; amino acids 1-102 of SEQ ID NO: 163; amino acids 1-104 of SEQ ID NO: 165; amino acids 1-104 of SEQ ID NO: 167; amino acids 1-104 of SEQ ID NO: 173; and amino acids 1-104 of SEQ ID NO: 175.

56. The polynucleotide of claim 55, wherein the encoded polypeptide comprises an amino acid sequence selected from the group consisting of amino acids 1-102 of SEQ ID NO: 63; amino acids 1-104 of SEQ ID NO: 71; amino acids 1-104 of SEQ ID NO: 167; and amino acids 1-104 of SEQ ID NO: 175.

57. The polynucleotide of claim 56, wherein the encoded polypeptide further includes additional flanking sequence from VEGF-A (SEQ ID NO: 2) or VEGF-C (SEQ ID NO: 22).

58. The polynucleotide of claim 55, wherein the encoded polypeptide further includes additional flanking sequence from VEGF-A (SEQ ID NO: 2) or VEGF-C (SEQ ID NO: 22).

59. An expression vector comprising an expression control sequence operatively linked to the polynucleotide according to claim 55.

60. An expression vector according to claim 59, wherein the expression control sequence comprises a promoter that promotes expression in a mammalian cell.

61. An isolated host cell transformed or transfected with a vector according to claim 60.

62. A method for producing a polypeptide that binds at least one human vascular endothelial growth factor receptor selected from the group consisting of VEGFR-1, VEGFR-2, and VEGFR-3, comprising:

growing a host cell according to claim 61 under conditions in which the cell expresses the polypeptide encoded by the polynucleotide.

63. The method of claim 62 further comprising the step of isolating the polypeptide from the cell or medium.

64. A polynucleotide comprising a nucleotide sequence that is at least 95% identical to nucleotides 8-322 of SEQ ID NO: 174, wherein the nucleotide sequence encodes a polypeptide that binds to at least one receptor selected from the group consisting of human VEGFR-1, human VEGFR-2, and human VEGFR-3.

65. The polynucleotide of claim 64 wherein the encoded polypeptide further includes additional flanking sequence from VEGF-A (SEQ ID NO: 2) or VEGF-C (SEQ ID NO: 22).

66. An expression vector comprising an expression control sequence operatively linked to the polynucleotide according to claim 64.

67. An expression vector according to claim 66, wherein the expression control sequence comprises a promoter that promotes expression in a mammalian cell.

68. An isolated host cell transformed or transfected with a vector according to claim 67.

69. A method for producing a polypeptide that binds at least one human vascular endothelial growth factor receptor selected from the group consisting of VEGFR-1, VEGFR-2, and VEGFR-3, comprising:

growing a host cell according to claim 68 under conditions in which the cell expresses the polypeptide encoded by the polynucleotide.

70. The method of claim 69 further comprising the step of isolating the polypeptide from the cell or medium.

71. A polynucleotide comprising a nucleotide sequence that encodes a polypeptide comprising an amino acid sequence at least 95% identical to an amino acid sequence selected from the group consisting of: amino acids 1-102 as set forth in SEQ ID NO: 51; amino acids 1-102 as set forth in SEQ ID NO: 59; amino acids 1-102 as set forth in SEQ ID NO: 63; amino acids 1-104 as set forth in SEQ ID NO: 67; amino acids 1-104 as set forth in SEQ ID NO: 71; amino acids 1-104 as set forth in SEQ ID NO: 75; amino acids 1-104 as set forth in SEQ ID NO: 77; amino acids 1-104 as set forth in SEQ ID NO: 153; amino acids 1-105 as set forth in SEQ ID NO: 155; amino acids 1-105 as set forth in SEQ ID NO: 157; amino acids 1-105 as set forth in SEQ ID NO: 159; amino acids 1-103 as set forth in SEQ ID NO: 161; amino acids 1-102 as set forth in SEQ ID NO: 163; amino acids 1-104 as set forth in SEQ ID NO: 165; amino acids 1-104 as set forth in SEQ ID NO: 167; amino acids 1-104 as set forth in SEQ ID NO: 169; amino acids 1-104 as set forth in SEQ ID NO: 171; amino acids 1-104 as set forth in SEQ ID NO: 173; and amino acids 1-104 as set forth in SEQ ID NO: 175, wherein the polypeptide binds to at least one human vascular endothelial growth factor receptor selected from VEGFR-1, VEGFR-2, and VEGFR-3.

72. The polynucleotide of claim 71, wherein the encoded polypeptide further includes additional flanking sequence from VEGF-A (SEQ ID NO: 2) or VEGF-C (SEQ ID NO: 22).

73. An expression vector comprising an expression control sequence operatively linked to the polynucleotide according to claim 71.

74. An expression vector according to claim 73, wherein the expression control sequence comprises a promoter that promotes expression in a mammalian cell.

75. An isolated host cell transformed or transfected with a vector according to claim 74.

76. A method for producing a polypeptide that binds at least one human vascular endothelial growth factor receptor selected from the group consisting of VEGFR-1, VEGFR-2, and VEGFR-3, comprising:

growing a host cell according to claim 75 under conditions in which the cell expresses the polypeptide encoded by the polynucleotide.

77. The method of claim 76 further comprising the step of isolating the polypeptide from the cell or medium.

78. A polynucleotide comprising a nucleotide sequence that encodes a polypeptide comprising an amino acid sequence at least 95% identical to an amino acid sequence selected from the group consisting of:

amino acids 1-102 of SEQ ID NO: 51; amino acids 1-102 of SEQ ID NO: 63; amino acids 1-104 of SEQ ID NO: 71; amino acids 1-104 of SEQ ID NO: 153; amino acids 1-103 of SEQ ID NO: 161; amino acids 1-102 of SEQ ID NO: 163; amino acids 1-104 of SEQ ID NO: 165; amino acids 1-104 of SEQ ID NO: 167; amino acids 1-104 of SEQ ID NO: 173; and amino acids 1-104 of SEQ ID NO: 175, wherein the polypeptide binds human vascular endothelial growth factor receptors VEGFR-1, VEGFR-2, and VEGFR-3.

79. The polynucleotide of claim 78, wherein the polypeptide further includes additional flanking sequence from VEGF-A (SEQ ID NO: 2) or VEGF-C (SEQ ID NO: 22).

80. An expression vector comprising an expression control sequence operatively linked to the polynucleotide according to claim 78.

81. An expression vector according to claim 80, wherein the expression control sequence comprises a promoter that promotes expression in a mammalian cell.

82. An Isolated host cell transformed or transfected with a vector according to claim 81.

83. A method for producing a polypeptide that binds at least one human vascular endothelial growth factor receptor selected from the group consisting of VEGFR-1, VEGFR-2, and VEGFR-3, comprising:

growing a host cell according to claim 82 under conditions in which the cell expresses the polypeptide encoded by the polynucleotide.

84. The method of claim 83 further comprising the step of isolating the polypeptide from the cell or medium.

85. A method for making a polynucleotide that encodes a polypeptide that modulates the growth of mammalian endothelial cells, comprising the steps of:

preparing polynucleotides that encode amino acid fragments of at least two vertebrate vascular endothelial growth factor polypeptides;

commingling the polynucleotides under conditions wherein the polynucleotides recombine to form hybrid polynucleotides;

expressing the hybrid polynucleotides to make hybrid polypeptides encoded by the hybrid polynucleotides;

screening the hybrid polypeptides to identify a hybrid polypeptide that binds to a receptor for a vertebrate vascular endothelial growth factor selected from the group consisting VEGFR-1, VEGFR-2 and VEGFR-3; and selecting the polynucleotide that encodes the hybrid polypeptide that binds to the receptor in the screening step wherein a polypeptide that binds to the receptor in the screening step is a polypeptide that modulates the growth of mammalian endothelial cells.

86. A method for making a polynucleotide that encodes a polypeptide that modulates the growth of mammalian endothelial cells, comprising the steps of:

preparing a set of polynucleotide fragments having the following characteristics:

the set includes a first subset of coding polynucleotide fragments, wherein each coding polynucleotide fragment of the first subset encodes at least four amino acids of the amino acid sequence of a first mammalian vascular endothelial growth factor;

the set includes a second subset of coding polynucleotide fragments, wherein each coding polynucleotide fragment of the second subset encodes at least four amino acids of the amino acid sequence of a second mammalian vascular endothelial growth factor;

commingling the polynucleotide fragments which comprise the set under conditions wherein the coding polynucleotide fragments from the first and second subsets recombine to form hybrid polynucleotides;

expressing the hybrid polynucleotides to make hybrid polypeptides encoded by the hybrid polynucleotides;

screening the hybrid polypeptides to identify a hybrid polypeptide that binds to a receptor for a vertebrate vascular endothelial growth factor selected from the group consisting VEGFR-1, VEGFR-2 and VEGFR-3 and modulates the growth of mammalian endothelial cells; and selecting the polynucleotide that encodes the hybrid polypeptide that modulates the growth of mammalian endothelial cells in the screening step.

* * * * *

UNITED STATES PATENT AND TRADEMARK OFFICE

CERTIFICATE OF CORRECTION

PATENT NO. : 7,309,604 B2
APPLICATION NO. : 11/064774
DATED : December 18, 2007
INVENTOR(S) : Kari Alitalo et al.

It is certified that error appears in the above-identified patent and that said Letters Patent is hereby corrected as shown below:

<u>In the Claims:</u>

In claim 9, at Column 98, line 58, please delete "$X_5$" and insert --$X_8$--.

Signed and Sealed this

Thirtieth Day of September, 2008

Jon W. Dudas

JON W. DUDAS
*Director of the United States Patent and Trademark Office*